US006525174B1

(12) United States Patent
Young et al.

(10) Patent No.: US 6,525,174 B1
(45) Date of Patent: Feb. 25, 2003

(54) PRECEREBELLIN-LIKE PROTEIN

(75) Inventors: Paul Young, Gaithersburg, MD (US); John M. Greene, Gaithersburg, MD (US); Ann M. Ferrie, Tewksbury, MA (US); Steven M. Ruben, Olney, MD (US); Craig A. Rosen, Laytonsville, MD (US); Jing-Shan Hu, Sunnyvale, CA (US); Henrik S. Olsen, Gaithersburg, MD (US); Reinhard Ebner, Gaithersburg, MD (US); Laurie A. Brewer, St. Paul, MN (US); Paul A. Moore, Germantown, MD (US); Yanggu Shi, Gaithersburg, MD (US); Charles Florence, Rockville, MD (US); Kimberly Florence, Rockville, MD (US); David W. Lafleur, Washington, DC (US); Jian Ni, Rockville, MD (US); Ping Fan, Gaithersburg, MD (US); Ying-Fei Wei, Berkeley, CA (US); Carrie L. Fischer, Burke, VA (US); Daniel R. Soppet, Centreville, VA (US); Yi Li, Sunnyvale, CA (US); Zhizhen Zeng, Gaithersburg, MD (US); Hla Kyaw, Frederick, MD (US); Guo-Liang Yu, Berkeley, CA (US); Ping Feng, Gaithersburg, MD (US); Patrick J. Dillon, Carlsbad, CA (US); Gregory A. Endress, Potomac, MD (US); Kenneth C. Carter, North Potomac, MD (US)

(73) Assignee: Human Genome Sciences, Inc., Rockville, MD (US)

( * ) Notice: Subject to any disclaimer, the term of this patent is extended or adjusted under 35 U.S.C. 154(b) by 0 days.

(21) Appl. No.: 09/205,258

(22) Filed: Dec. 4, 1998

Related U.S. Application Data

(63) Continuation-in-part of application No. PCT/US98/11422, filed on Jun. 4, 1998.
(60) Provisional application No. 60/070,923, filed on Dec. 18, 1997, provisional application No. 60/094,657, filed on Jul. 30, 1998, provisional application No. 60/048,885, filed on Jun. 6, 1997, provisional application No. 60/049,375, filed on Jun. 6, 1997, provisional application No. 60/048,881, filed on Jun. 6, 1997, provisional application No. 60/048,880, filed on Jun. 6, 1997, provisional application No. 60/048,896, filed on Jun. 6, 1997, provisional application No. 60/049,020, filed on Jun. 6, 1997, provisional application No. 60/048,876, filed on Jun. 6, 1997, provisional application No. 60/048,895, filed on Jun. 6, 1997, provisional application No. 60/048,884, filed on Jun. 6, 1997, provisional application No. 60/048,894, filed on Jun. 6, 1997, provisional application No. 60/048,971, filed on Jun. 6, 1997, provisional application No. 60/048,964, filed on Jun. 6, 1997, provisional application No. 60/048,882, filed on Jun. 6, 1997, provisional application No. 60/048,899, filed on Jun. 6, 1997, provisional application No. 60/048,893, filed on Jun. 6, 1997, provisional application No. 60/048,900, filed on Jun. 6, 1997, provisional application No. 60/048,901, filed on Jun. 6, 1997, provisional application No. 60/048,892, filed on Jun. 6, 1997, provisional application No. 60/048,915, filed on Jun. 6, 1997, provisional application No. 60/049,019, filed on Jun. 6, 1997, provisional application No. 60/048,970, filed on Jun. 6, 1997, provisional application No. 60/048,972, filed on Jun. 6, 1997, provisional application No. 60/048,916, filed on Jun. 6, 1997, provisional application No. 60/049,373, filed on Jun. 6, 1997, provisional application No. 60/048,875, filed on Jun. 6, 1997, provisional application No. 60/049,374, filed on Jun. 6, 1997, provisional application No. 60/048,917, filed on Jun. 6, 1997, provisional application No. 60/048,949, filed on Jun. 6, 1997, provisional application No. 60/048,974, filed on Jun. 6, 1997, provisional application No. 60/048,883, filed on Jun. 6, 1997, provisional application No. 60/048,897, filed on Jun. 6, 1997, provisional application No. 60/048,898, filed on Jun. 6, 1997, provisional application No. 60/048,962, filed on Jun. 6, 1997, provisional application No. 60/048,963, filed on Jun. 6, 1997, provisional application No. 60/048,877, filed on Jun. 6, 1997, provisional application No. 60/048,878, filed on Jun. 6, 1997, provisional application No. 60/057,645, filed on Sep. 5, 1997, provisional application No. 60/057,642, filed on Sep. 5, 1997, provisional application No. 60/057,668, filed on Sep. 5, 1997, provisional application No. 60/057,635, filed on Sep. 5, 1997, provisional application No. 60/057,627, filed on Sep. 5, 1997, provisional application No. 60/057,667, filed on Sep. 5, 1997, provisional application No. 60/057,666, filed on Sep. 5, 1997, provisional application No. 60/057,764, filed on Sep. 5, 1997, provisional application No. 60/057,643, filed on Sep. 5, 1997, provisional application No. 60/057,769, filed on Sep. 5, 1997, provisional application No. 60/057,763, filed on Sep. 5, 1997, provisional application No. 60/057,650, filed on Sep. 5, 1997, provisional application No. 60/057,584, filed on Sep. 5, 1997, provisional application No. 60/057,647, filed on Sep. 5, 1997, provisional application No. 60/057,661, filed on Sep. 5, 1997, provisional application No. 60/057,662, filed on Sep. 5, 1997, provisional application No. 60/057,646, filed on Sep. 5, 1997, provisional application No. 60/057,654, filed on Sep. 5, 1997, provisional application No. 60/057,651, filed on Sep. 5, 1997, provisional application No. 60/057,644, filed on Sep. 5, 1997, provisional application No. 60/057,765, filed on Sep. 5, 1997, provisional application No. 60/057,762, filed on Sep. 5, 1997, provisional application No. 60/057,775, filed on Sep. 5, 1997, provisional application No. 60/057,648, filed on Sep. 5, 1997, provisional application No. 60/057,774, filed on Sep. 5, 1997, provisional application No. 60/057,649, filed on Sep. 5, 1997, provisional application No. 60/057,770, filed on Sep. 5, 1997, provisional application No. 60/057,771, filed on Sep. 5, 1997, provisional application No. 60/057,761, filed on Sep. 5, 1997, provisional application No. 60/057,760, filed on Sep. 5, 1997, provisional application No. 60/057,776, filed on Sep. 5, 1997, provisional application No. 60/057,778, filed on Sep. 5, 1997, provisional application No. 60/057,629, filed on Sep. 5, 1997, provisional application No. 60/057,628, filed on Sep. 5, 1997, provisional application No. 60/057,777, filed on Sep. 5, 1997, provisional application No. 60/057,634, filed on Sep. 5, 1997, provisional application No. 60/070,923, filed on Dec. 18, 1997, provisional application No. 60/092,921, filed on Jul. 15, 1998, provisional application No. 60/094,657, filed on Jul. 30, 1998.

(51) Int. Cl.[7] .................. C07K 14/47; A61K 38/18; C12P 21/00
(52) U.S. Cl. .................. 530/350; 435/69.1; 514/2
(58) Field of Search .................. 530/350; 435/7.21, 435/69.1; 514/2

(56) References Cited

FOREIGN PATENT DOCUMENTS

| WO | WO 99/07736 | 2/1999 |
| WO | WO 99/42576 | 8/1999 |

WO  WO 00/48625  8/2000

OTHER PUBLICATIONS

Mugnani et al., "The neuropeptide cerebellin is a marker for two similar neuronla circuits in rat brain", PNAS (1987) vol. 84 pp. 8692–8698.*
Kavety et al., "Genomic structure and mapping of precerebellin and a precerebellin–related gene", Molec. Brain Res. (1994) vol. 27 pp. 152–156.*
Urade et al., "Precerebellin isa cerebellum–spcific protein with similarity to the globular domain of complement C1q B chain", PNAS (1991) vol. 88 pp. 1069–1073.*
Baker et al. Protein structure prediction and structural genomics. Science (Oct. 5, 2001) vol. 294, pp. 93–96.*
Satoh et al. "Cerebellin and cerebellin mRNA in the human brain, adrenal glands and the tumour tissues of adrenal tumour, ganglioneuroblastoma and neuroblastoma," J. Endocrinol. 154:27–34 (1997).
Urade et al., "Precerebellin is a cerebellum–specific protein with similarity to the globular domain of complement C1q B chain", Proc. Natl. Acad. Sci. USA, 88:1069–1073 (Feb. 1991).
Geneseq Accession No. Y99420 (Mar. 9, 2000).
Geneseq Accession No. Y99402 (Mar. 9, 2000).
Pang et al., "Cbln3, a Novel Member of the Precerebellin Family that Binds Specifically to Cbln 1", J. Neuroscience, 20(17):6333–9 (Sep. 1, 2000).
Genbank Accession No. AAF32314 (Sep. 19, 2000).
Genbank Accession No. Q9R171 (Oct. 1, 2000).
Genbank Accession No. A37873 (Sep. 10, 1997).
Genbank Accession No. A60032 (Jul. 28, 1995).
Genbank Accession No. AF218379 (Sep. 19, 2000).
Genbank Accession No. AAA35676 (Apr. 27, 1993).
Genbank Accession No. AF218380 (Sep. 19, 2000).
Genbank Accession No. M58583 (Apr. 27, 1993).
Genbank Accession No. S76975 (Jul. 27, 1995).
Genbank Accession No. AA323018 (Apr. 20, 1997).
Genbank Accession No. AA323159 (Apr. 20, 1997).
Genbank Accession No. R13472 (Apr. 12, 1995).
Genbank Accession No. AA304816 (Apr. 18, 1997).
Genbank Accession No. AA323409 (Apr. 20, 1997).

* cited by examiner

*Primary Examiner*—John S. Brusca
*Assistant Examiner*—Marjorie A. Moran
(74) *Attorney, Agent, or Firm*—Human Genome Sciences, Inc.

(57) ABSTRACT

The present invention relates to novel human secreted proteins and isolated nucleic acids containing the coding regions of the genes encoding such proteins. Also provided are vectors, host cells, antibodies, and recombinant methods for producing human secreted proteins. The invention further relates to diagnostic and therapeutic methods useful for diagnosing and treating disorders related to these novel human secreted proteins.

19 Claims, No Drawings

PRECEREBELLIN-LIKE PROTEIN

This application claims benefit under 35 U.S.C. 119(e) from U.S. Provisional Patent Application Serial Nos. 60/070,923; 60/092,921 and 60/094,657, and this application is a continuation-in-part of, and claims benefit under 35 U.S.C. §120 of copending United States patent application Serial No: PCT/US98/11422, filed Jun. 4, 1998, which is hereby incorporated herein by reference, which claims benefit under 35 U.S.C. §119(e) based on U.S. Provisional Applications:

| | Filing Date | Appln No. |
|---|---|---|
| 1. | 06-June-1997 | 60/048,885 |
| 2. | 06-June-1997 | 60/049,375 |
| 3. | 06-June-1997 | 60/048,881 |
| 4. | 06-June-1997 | 60/048,880 |
| 5. | 06-June-1997 | 60/048,896 |
| 6. | 06-June-1997 | 60/049,020 |
| 7. | 06-June-1997 | 60/048,876 |
| 8. | 06-June-1997 | 60/048,895 |
| 9. | 06-June-1997 | 60/048,884 |
| 10. | 06-June-1997 | 60/048,894 |
| 11. | 06-June-1997 | 60/048,971 |
| 12. | 06-June-1997 | 60/048,964 |
| 13. | 06-June-1997 | 60/048,882 |
| 14. | 06-June-1997 | 60/048,899 |
| 15. | 06-June-1997 | 60/048,893 |
| 16 | 06-June-1997 | 60/048,900 |
| 17. | 06-June-1997 | 60/048,901 |
| 18. | 06-June-1997 | 60/048,892 |
| 19. | 06-June-1997 | 60/048,915 |
| 20. | 06-June-1997 | 60/049,019 |
| 21. | 06-June-1997 | 60/048,970 |
| 22. | 06-June-1997 | 60/048,972 |
| 23. | 06-June-1997 | 60/048,916 |
| 24. | 06-June-1997 | 60/049,373 |
| 25. | 06-June-1997 | 60/048,875 |
| 26. | 06-June-1997 | 60/049,374 |
| 27. | 06-June-1997 | 60/048,917 |
| 28. | 06-June-1997 | 60/048,949 |
| 29. | 06-June-1997 | 60/048,974 |
| 30. | 06-June-1997 | 60/048,883 |
| 31. | 06-June-1997 | 60/048,897 |
| 32. | 06-June-1997 | 60/048,898 |
| 33. | 06-June-1997 | 60/048,962 |
| 34. | 06-June-1997 | 60/048,963 |
| 35. | 06-June-1997 | 60/048,877 |
| 36. | 06-June-1997 | 60/048,878 |
| 37. | 05-Sept.-1997 | 60/057,645 |
| 38. | 05-Sept.-1997 | 60/057,642 |
| 39. | 05-Sept.-1997 | 60/057,668 |
| 40. | 05-Sept.-1997 | 60/057,635 |
| 41. | 05-Sept.-1997 | 60/057,627 |
| 42. | 05-Sept.-1997 | 60/057,667 |
| 43. | 05-Sept.-1997 | 60/057,666 |
| 44. | 05-Sept.-1997 | 60/057,764 |
| 45. | 05-Sept.-1997 | 60/057,643 |
| 46. | 05-Sept.-1997 | 60/057,769 |
| 47. | 05-Sept.-1997 | 60/057,763 |
| 48. | 05-Sept.-1997 | 60/057,650 |
| 49. | 05-Sept.-1997 | 60/057,584 |
| 50. | 05-Sept.-1997 | 60/057,647 |
| 51. | 05-Sept.-1997 | 60/057,661 |
| 52. | 05-Sept.-1997 | 60/057,662 |
| 53. | 05-Sept.-1997 | 60/057,646 |
| 54. | 05-Sept.-1997 | 60/057,654 |
| 55. | 05-Sept.-1997 | 60/057,651 |
| 56. | 05-Sept.-1997 | 60/057,644 |
| 57. | 05-Sept.-1997 | 60/057,765 |
| 58. | 05-Sept.-1997 | 60/057,762 |
| 59. | 05-Sept.-1997 | 60/057,775 |
| 60. | 05-Sept.-1997 | 60/057,648 |
| 61. | 05-Sept.-1997 | 60/057,774 |
| 62. | 05-Sept.-1997 | 60/057,649 |
| 63. | 05-Sept.-1997 | 60/057,770 |

-continued

| | Filing Date | Appln No. |
|---|---|---|
| 64. | 05-Sept.-1997 | 60/057,771 |
| 65. | 05-Sept.-1997 | 60/057,761 |
| 66. | 05-Sept.-1997 | 60/057,760 |
| 67. | 05-Sept.-1997 | 60/057,776 |
| 68. | 05-Sept.-1997 | 60/057,778 |
| 69. | 05-Sept.-1997 | 60/057,629 |
| 70. | 05-Sept.-1997 | 60/057,628 |
| 71. | 05-Sept.-1997 | 60/057,777 |
| 72. | 05-Sept.-1997 | 60/057,634 |
| 73. | 18-Dec.-1997 | 60/070,923 |
| 74. | 15-July-1998 | 60/092,921 |
| 75. | 30-July-1998 | 60/094,657 |

FIELD OF THE INVENTION

This invention relates to newly identified polynucleotides and the polypeptides encoded by these polynucleotides, uses of such polynucleotides and polypeptides, and their production.

BACKGROUND OF THE INVENTION

Unlike bacterium, which exist as a single compartment surrounded by a membrane, human cells and other eucaryotes are subdivided by membranes into many functionally distinct compartments. Each membrane-bounded compartment, or organelle, contains different proteins essential for the function of the organelle. The cell uses "sorting signals," which are amino acid motifs located within the protein, to target proteins to particular cellular organelles.

One type of sorting signal, called a signal sequence, a signal peptide, or a leader sequence, directs a class of proteins to an organelle called the endoplasmic reticulum (ER). The ER separates the membrane-bounded proteins from all other types of proteins. Once localized to the ER, both groups of proteins can be further directed to another organelle called the Golgi apparatus. Here, the Golgi distributes the proteins to vesicles, including secretory vesicles, the cell membrane, lysosomes, and the other organelles.

Proteins targeted to the ER by a signal sequence can be released into the extracellular space as a secreted protein. For example, vesicles containing secreted proteins can fuse with the cell membrane and release their contents into the extracellular space—a process called exocytosis. Exocytosis can occur constitutively or after receipt of a triggering signal. In the latter case, the proteins are stored in secretory vesicles (or secretory granules) until exocytosis is triggered. Similarly, proteins residing on the cell membrane can also be secreted into the extracellular space by proteolytic cleavage of a "linker" holding the protein to the membrane.

Despite the great progress made in recent years, only a small number of genes encoding human secreted proteins have been identified. These secreted proteins include the commercially valuable human insulin, interferon, Factor VIII, human growth hormone, tissue plasminogen activator, and erythropoeitin. Thus, in light of the pervasive role of secreted proteins in human physiology, a need exists for identifying and characterizing novel human secreted proteins and the genes that encode them. This knowledge will allow one to detect, to treat, and to prevent medical disorders by using secreted proteins or the genes that encode them.

SUMMARY OF THE INVENTION

The present invention relates to novel polynucleotides and the encoded polypeptides. Moreover, the present invention relates to vectors, host cells, antibodies, and recombinant methods for producing the polypeptides and polynucleotides. Also provided are diagnostic methods for detecting disorders related to the polypeptides, and therapeutic methods for treating such disorders. The invention further relates to screening methods for identifying binding partners of the polypeptides.

DETAILED DESCRIPTION

Definitions

The following definitions are provided to facilitate understanding of certain terms used throughout this specification.

In the present invention, "isolated" refers to material removed from its original environment (e.g., the natural environment if it is naturally occurring), and thus is altered "by the hand of man" from its natural state. For example, an isolated polynucleotide could be part of a vector or a composition of matter, or could be contained within a cell, and still be "isolated" because that vector, composition of matter, or particular cell is not the original environment of the polynucleotide.

In the present invention, a "secreted" protein refers to those proteins capable of being directed to the ER, secretory vesicles, or the extracellular space as a result of a signal sequence, as well as those proteins released into the extracellular space without necessarily containing a signal sequence. If the secreted protein is released into the extracellular space, the secreted protein can undergo extracellular processing to produce a "mature" protein. Release into the extracellular space can occur by many mechanisms, including exocytosis and proteolytic cleavage.

As used herein, a "polynucleotide" refers to a molecule having a nucleic acid sequence contained in SEQ ID NO:X or the cDNA contained within the clone deposited with the ATCC. For example, the polynucleotide can contain the nucleotide sequence of the full length cDNA sequence, including the 5' and 3' untranslated sequences, the coding region, with or without the signal sequence, the secreted protein coding region, as well as fragments, epitopes, domains, and variants of the nucleic acid sequence. Moreover, as used herein, a "polypeptide" refers to a molecule having the translated amino acid sequence generated from the polynucleotide as broadly defined.

In the present invention, the full length sequence identified as SEQ ID NO:X was often generated by overlapping sequences contained in multiple clones (contig analysis). A representative clone containing all or most of the sequence for SEQ ID NO:X was deposited with the American Type Culture Collection ("ATCC"). As shown in Table 1, each clone is identified by a cDNA Clone ID (Identifier) and the ATCC Deposit Number. The ATCC is located at 10801 University Boulevard, Manassas, Va. 20110-2209, USA. The ATCC deposit was made pursuant to the terms of the Budapest Treaty on the international recognition of the deposit of microorganisms for purposes of patent procedure.

A "polynucleotide" of the present invention also includes those polynucleotides capable of hybridizing, under stringent hybridization conditions, to sequences contained in SEQ ID NO:X, the complement thereof, or the cDNA within the clone deposited with the ATCC. "Stringent hybridization conditions" refers to an overnight incubation at 42° C. in a solution comprising 50% formamide, 5×SSC (750 mM NaCl, 75 mM sodium citrate), 50 mM sodium phosphate (pH 7.6), 5×Denhardt's solution, 10% dextran sulfate, and 20 $\mu$g/ml denatured, sheared salmon sperm DNA, followed by washing the filters in 0.1×SSC at about 65° C.

Also contemplated are nucleic acid molecules that hybridize to the polynucleotides of the present invention at lower stringency hybridization conditions. Changes in the stringency of hybridization and signal detection are primarily accomplished through the manipulation of formanide concentration (lower percentages of formamide result in lowered stringency); salt conditions, or temperature. For example, lower stringency conditions include an overnight incubation at 37° C. in a solution comprising 6×SSPE (20×SSPE=3M NaCl; 0.2M $NaH_2PO_4$; 0.02M EDTA, pH 7.4), 0.5% SDS, 30% formamide, 100 ug/ml salmon sperm blocking DNA; followed by washes at 50° C. with 1×SSPE, 0.1% SDS. In addition, to achieve even lower stringency, washes performed following stringent hybridization can be done at higher salt concentrations (e.g. 5×SSC).

Note that variations in the above conditions may be accomplished through the inclusion and/or substitution of alternate blocking reagents used to suppress background in hybridization experiments. Typical blocking reagents include Denhardt's reagent, BLOTTO, heparin, denatured salmon sperm DNA, and commercially available proprietary formulations. The inclusion of specific blocking reagents may require modification of the hybridization conditions described above, due to problems with compatibility.

Of course, a polynucleotide which hybridizes only to polyA+ sequences (such as any 3' terminal polyA+ tract of a cDNA shown in the sequence listing), or to a complementary stretch of T (or U) residues, would not be included in the definition of "polynucleotide," since such a polynucleotide would hybridize to any nucleic acid molecule containing a poly (A) stretch or the complement thereof (e.g., practically any double-stranded cDNA clone).

The polynucleotide of the present invention can be composed of any polyribonucleotide or polydeoxribonucleotide, which may be unmodified RNA or DNA or modified RNA or DNA. For example, polynucleotides can be composed of single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. In addition, the polynucleotide can be composed of triple-stranded regions comprising RNA or DNA or both RNA and DNA. A polynucleotide may also contain one or more modified bases or DNA or RNA backbones modified for stability or for other reasons. "Modified" bases include, for example, tritylated bases and unusual bases such as inosine. A variety of modifications can be made to DNA and RNA; thus, "polynucleotide" embraces chemically, enzymatically, or metabolically modified forms.

The polypeptide of the present invention can be composed of amino acids joined to each other by peptide bonds or modified peptide bonds, i.e., peptide isosteres, and may contain amino acids other than the 20 gene-encoded amino acids. The polypeptides may be modified by either natural processes, such as posttranslational processing, or by chemical modification techniques which are well known in the art. Such modifications are well described in basic texts and in more detailed monographs, as well as in a voluminous research literature. Modifications can occur anywhere in a polypeptide, including the peptide backbone, the amino acid side-chains and the amino or carboxyl termini. It will be appreciated that the same type of modification may be present in the same or varying degrees at several sites in a given polypeptide. Also, a given polypeptide may contain many types of modifications. Polypeptides may be branched, for example, as a result of ubiquitination, and they may be cyclic, with or without branching. Cyclic, branched, and branched cyclic polypeptides may result from posttranslation natural processes or may be made by synthetic methods. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristoylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, PROTEINS—STRUCTURE AND MOLECULAR PROPERTIES, 2nd Ed., T. E. Creighton, W. H. Freeman and Company, New York (1993); POSTTRANSLATIONAL COVALENT MODIFICATION OF PROTEINS, B. C. Johnson, Ed., Academic Press, New York, pgs. 1–12 (1983); Seifter et al., Meth Enzymol 182:626–646 (1990); Rattan et al., Ann NY Acad Sci 663:48–62 (1992).)

"SEQ ID NO:X" refers to a polynucleotide sequence while "SEQ ID NO:Y" refers to a polypeptide sequence, both sequences identified by an integer specified in Table 1.

"A polypeptide having biological activity" refers to polypeptides exhibiting activity similar, but not necessarily identical to, an activity of a polypeptide of the present invention, including mature forms, as measured in a particular biological assay, with or without dose dependency. In the case where dose dependency does exist, it need not be identical to that of the polypeptide, but rather substantially similar to the dose-dependence in a given activity as compared to the polypeptide of the present invention (i.e., the candidate polypeptide will exhibit greater activity or not more than about 25-fold less and, preferably, not more than about tenfold less activity, and most preferably, not more than about three-fold less activity relative to the polypeptide of the present invention.)

Polynucleotides and Polypeptides of the Invention
Features of Protein Encoded by Gene No: 1

This gene is expressed primarily in melanocytes and, to a lesser extent, in testes, ovary, kidney and other tissues.

Therefore, polynucleotides and polypeptides of the invention are useful as reagents for differential identification of the tissue(s) or cell type(s) present in a biological sample and for diagnosis of diseases and conditions which include, but are not limited to, disorders of neural crest derived cells including pigmentation defects, melanoma, reproductive organ defects, and defects of the kidney. Similarly, polypeptides and antibodies directed to these polypeptides are useful in providing immunological probes for differential identification of the tissue(s) or cell type(s). For a number of disorders of the above tissues or cells, particularly of the skin, reproductive, and renal systems, expression of this gene at significantly higher or lower levels. may be routinely detected in certain tissues or cell types (e.g. melanocytes, testes, ovary, kidney, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in melanocytes indicates that the protein product of this gene is useful for treating disorders that arise from alterations in the number or fate of neural crest derived cells including cancers such as melanoma and defects of the developing reproductive system.

Many polynucleotide sequences, such as EST sequences, are publicly available and accessible through sequence databases. Some of these sequences are related to SEQ ID NO:11 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2512 of SEQ ID NO:11, b is an integer of 15 to 2526, where both a and b correspond to the positions of nucleotide residues shown in SEQ ID NO:11, and where b is greater than or equal to a+14.

Features of Protein Encoded by Gene No: 2

One embodiment of this invention is a polypeptide comprising the following amino acid sequence: ENMICVK-CLPQYPEHSKHV (SEQ ID NO:487). An additional embodiment is the polynucleotides encoding these polypeptides.

This gene is expressed primarily in infant brain and fetal lung.

Therefore, polynucleotides and polypeptides of the invention are useful as reagents for differential identification of the tissue(s) or cell type(s) present in a biological sample and for diagnosis of diseases and conditions which include, but are not limited to, developmental disorders of the brain or lung. Similarly, polypeptides and antibodies directed to these polypeptides are useful in providing immunological probes for differential identification of the tissue(s) or cell type(s). For a number of disorders of the above tissues or cells, particularly of the central nervous and pulmonary systems, expression of this gene at significantly higher or lower levels may be routinely detected in certain tissues or cell types (e.g. brain, lung, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in infant brain and fetal lung indicates that the protein product of this gene is useful for treating or diagnosing disorders associated with abnormal proliferation of cells in the Central nervous system and developing lung. Furthermore, the protein product of this gene is useful for the detection/treatment of neurodegenerative disease states and behavioural disorders such as Alzheimers Disease, Parkinsons Disease, Huntingtons Disease, Tourette Syndrome, schizophrenia, mania, dementia, paranoia, obsessive compulsive disorder, panic disorder, learning disabilities, ALS, psychoses, autism, and altered bahaviors, including disorders in feeding, sleep patterns, balance, and perception. In addition, the gene or gene product may also play a role in the treatment and/or detection of developmental disorders associated with the developing embryo, or sexually-linked disorders. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:12 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1117 of SEQ ID NO:12, b is an integer of 15 to 1131, where both a and b correspond to the positions of nucleotide residues shown in SEQ ID NO:12; and where b is greater than or equal to a+14.

Features of Protein Encoded by Gene No: 3

One embodiment of this invention is a polypeptide the following amino acid sequence: ARVAFHLICRYILPTVY-CHV (SEQ ID NO:488). An additional embodiment is the polynucleotides encoding these polypeptides.

This gene is expressed primarily in breast lymph node, and to a lesser extent, in ovarian cancer and chondrosarcoma.

Therefore, polynucleotides and polypeptides of the invention are useful as reagents for differential identification of the tissue(s) or cell type(s) present in a biological sample and for diagnosis of diseases and conditions which include, but are not limited to, immune responses such as inflammation or immune surveillance for tumors. This gene may be important for inflammatory responses associated with tumors. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. lymph nodes, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 251 as residues: Lys-45 to Val-50, and/or Lys-69 to Arg-76.

The tissue distribution in breast lymph node indicates that the protein product of this gene is useful for the treatment or diagnosis of immune responses, including those associated with tumor-induced inflammation. Furthermore, given the tissue distribution, the gene product may also be involved in lymphopoiesis. In a case such as this, it can be used in immune disorders such as infection, inflammation, allergy, immunodeficiency etc. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:13 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 927 of SEQ ID NO:13, b is an integer of 15 to 941, where both a and b correspond to the positions of nucleotide residues shown in SEQ ID NO:13, and where b is greater than or equal to a+14.

Features of Protein Encoded by Gene No: 4

One embodiment of this invention is a polypeptide comprising the following amino acid sequence: ELVESP-GAAGNSARSGNVVC (SEQ ID NO:489). An additional embodiment is the polynucleotides encoding these polypeptides.

This gene is expressed primarily in T-cells and T-cell lymphomas.

Therefore, polynucleotides and polypeptides of the invention are useful as reagents for differential identification of the tissue(s) or cell type(s) present in a biological sample and for diagnosis of diseases and conditions which include, but are not limited to, immunological diseases involving T-cells such as inflammation, autoimmunity, and cancers including T-cell lymphomas. Similarly, polypeptides and antibodies directed to these polypeptides are useful in providing immunological probes for differential identification of the tissue(s) or cell type(s). For a number of disorders of the above tissues or cells, particularly of T-cells and other cells of the immune system, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in T-cells and T-cell lymphomas indicates that the protein product of this gene is useful for diagnosing and treating T-cell based disorders such as inflammatory diseases, autoimmune disease and tumors including T-cell lymphomas. Furthermore, the tissue distribution indicates that the polypeptides or polynucleotides are useful for the treatment, prophylaxis, and diagnosis of immune and autoimmune diseases, such as lupus, transplant rejection, allergic reactions, arthritis, asthma, immunodeficiency diseases, leukemia, and AIDS. Additionally, expression of this gene product in T cells also strongly indicates a role for this protein in immune function and immune surveillance. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:14 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 829 of SEQ ID NO:14, b is an integer of 15 to 843, where both a and b correspond to the positions of nucleotide residues shown in SEQ ID NO:14, and where b is greater than or equal to a+14.

Features of Protein Encoded by Gene No: 5

This gene is expressed primarily in activated monocytes.

Therefore, polynucleotides and polypeptides of the invention are useful as reagents for differential identification of the tissue(s) or cell type(s) present in a biological sample and for diagnosis of diseases and conditions which include, but are not limited to, inflammation, autoimmunity, infection, or disorders involving activation of monocytes. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 253 as residues: Asp-19 to Arg-31.

The tissue distribution indicates that the protein product of this gene is useful for diagnosing or treating diseases that result in activation of monocytes including infections, inflammatory responses or autoimmune diseases. Furthermore, expression of this gene product in monocytes also strongly indicates a role for this protein in immune function and immune surveillance.

Many polynucleotide sequences, such as EST sequences, are publicly available and accessible through sequence databases. Some of these sequences are related to SEQ ID NO:15 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1004 of SEQ ID NO:15, b is an integer of 15 to 1018, where both a and b correspond to the positions of nucleotide residues shown in SEQ ID NO:15, and where b is greater than or equal to a+14.

Features of Protein Encoded by Gene No: 6

The translation product of this gene shares sequence homology with terminal deoxynucleotidyltransferase which is thought to be important in catalyzing the elongation of oligo- or polydeoxynucleotide chains. One embodiment of this invention is a polypeptide comprising the following amino acid sequence: FKKLVNPRXQGIRHEEE-AVSWQERR (SEQ ID NO:490). An additional embodiment is the polynucleotides encoding these polypeptides.

This gene is expressed primarily in activated human neutrophils, and to a lesser extent in T-cells, primary dendritic cells and bone marrow cells.

Therefore, polynucleotides and polypeptides of the invention are useful as reagents for differential identification of the tissue(s) or cell type(s) present in a biological sample and for diagnosis of diseases and conditions which include, but are not limited to, cancers, particularly those of the blood such as leukemia and deficiencies in neutrophils such as neutropenia, and immune system disorders. Similarly, polypeptides and antibodies directed to these polypeptides are useful in providing immunological probes for differential identification of the tissue(s) or cell type(s). For a number of disorders of the above tissues or cells, particularly of the cardiovascular and immune systems, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neutrophils and other immune cells, combined with the homology to terminal deoxynucleotidyltransferase indicates that the protein product of this gene is useful for the treatment and differential diagnosis of acute leukemias. Alternatively, this gene may function in the proliferation of neutrophils and be useful as a treatment for neutropenia, for example, following neutropenia as a result of chemotherapy. Additionally, the tissue distribution indicates that the protein product of this gene is useful for the diagnosis and/or treatment of hematopoietic disorders. This gene product is primarily expressed in hematopoietic cells and tissues, suggesting that it plays a role in the survival, proliferation, and/or differentiation of hematopoieitic lineages. This is particularly supported by the expression of this gene product in bone marrow, which is a primary site of definitive hematopoiesis. Expression of this gene product in T cells and primary dendritic cells also strongly indicates a role for this protein in immune function and immune surveillance.

Many polynucleotide sequences, such as EST sequences, are publicly available and accessible through sequence databases. Some of these sequences are related to SEQ ID NO:16 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 647 of SEQ ID NO:16, b is an integer of 15 to 661, where both a and b correspond to the positions of nucleotide residues shown in SEQ ID NO:16, and where b is greater than or equal to a+14.

Features of Protein Encoded by Gene No: 7

The translation product of this gene exhibits a reasonable homology to the human chorionic gonadotropic (HCG) analogue-GT beta-subunit as disclosed in U.S. Pat. No. 5,508,261 and PCT Publication No. WO 92/22568. There is a high degree of conservation of the structurally important cysteine residues between these proteins.

This gene is expressed primarily in IL-1 and LPS induced neutrophils.

Therefore, polynucleotides and polypeptides of the invention are useful as reagents for differential identification of the tissue(s) or cell type(s) present in a biological sample and for diagnosis of diseases and conditions which include, but are not limited to, diseases of the immune system, including inflammatory diseases and allergies. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neutrophils indicates that the protein product of this gene is useful for the treatment/diagnosis of diseases of the immune system, since expression is primarily in neutrophils, and thus the translation product of this gene may be useful as a growth factor for the differentiation and/or proliferation of neutrophils for the treatment of neutropenia, for example following chemotherapy.

Many polynucleotide sequences, such as EST sequences, are publicly available and accessible through sequence databases. Some of these sequences are related to SEQ ID NO:17 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 539 of SEQ ID NO:17, b is an integer of 15 to 553, where both a and b correspond to the positions of nucleotide residues shown in SEQ ID NO:17, and where b is greater than or equal to a+14.

Features of Protein Encoded by Gene No: 8

This gene is expressed primarily in IL-1 and LPS-induced neutrophils.

Therefore, polynucleotides and polypeptides of the invention are useful as reagents for differential identification of the tissue(s) or cell type(s) present in a biological sample and for diagnosis of diseases and conditions which include, but are not limited to, diseases of the immune system, including inflammatory diseases and allergies. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 256 as residues: Ser-14 to Pro-22, and/or Leu-43 to Val-53.

The tissue distribution in neutrophils indicates that the protein product of this gene is useful for the treatment and diagnosis of diseases of the immune system, since expression is primarily in neutrophils, and thus the translation product of this gene may be useful as a growth factor for the differentiation and/or proliferation of neutrophils for the treatment of neutropenia, for example following chemotherapy.

Many polynucleotide sequences, such as EST sequences, are publicly available and accessible through sequence databases. Some of these sequences are related to SEQ ID NO:18 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 855 of SEQ ID NO:18, b is an integer of 15 to 869, where both a and b correspond to the positions of nucleotide residues shown in SEQ ID NO:18, and where b is greater than or equal to a+14.

Features of Protein Encoded by Gene No: 9

When tested against Jurkat cell lines, supernatants removed from cells expressing this gene activated the NF-kB transcription factor. Thus, it is likely that the protein encoded by this gene activates Jurkat cells by activating a transcriptional factor found within these cells. Nuclear factor kB is a transcription factor activated by a wide variety of agents, leading to cell activation, differentiation, or apoptosis. Reporter constructs utilizing the NF-kB promoter element are used to screen supernatants for such activity.

This gene is expressed primarily in IL-1 and LPS induced neutrophils.

Therefore, polynucleotides and polypeptides of the invention are useful as reagents for differential identification of the tissue(s) or cell type(s) present in a biological sample and for diagnosis of diseases and conditions which include, but are not limited to, diseases of the immune system, including inflammatory diseases and allergies. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 257 as residues: Tyr-22 to His-35.

The tissue distribution in neutrophils, combined with the biological activity data suggest that the protein product of this gene is useful for the treatment and/or diagnosis of diseases of the immune system, since expression is primarily in neutrophils, and thus the translation product of this gene may be useful as a growth factor for the differentiation and/or proliferation of neutrophils for the treatment of neutropenia, for example following chemotherapy.

Many polynucleotide sequences, such as EST sequences, are publicly available and accessible through sequence databases. Some of these sequences are related to SEQ ID NO:19 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 945 of SEQ ID NO:19, b is an integer of 15 to 959, where both a and b correspond to the positions of nucleotide residues shown in SEQ ID NO:19, and where b is greater than or equal to a+14.

Features of Protein Encoded by Gene No: 10

This gene is expressed primarily in activated T-cells and to a lesser extent in endothelial cells.

Therefore, polynucleotides and polypeptides of the invention are useful as reagents for differential identification of the tissue(s) or cell type(s) present in a biological sample and for diagnosis of diseases and conditions which include, but are not limited to, immune dysfunctions including cancer of the T lymphocytes and autoimmune disorders and inflammation. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in activated T-cells indicates that the protein product of this gene is useful for the treatment and/or diagnosis of immune disorders, particularly of T-cell origin, and may act as a growth factor for particular subsets of T-cells such as CD4 positive cells, which would make this a useful therapeutic for the treatment of HIV and other immune compromising illnesses. Furthermore, this gene product may be involved in the regulation of cytokine production, antigen presentation, or other processes that may also suggest a usefulness in the treatment of AIDS or other immune compromising diseases (e.g. by boosting immune responses).

Many polynucleotide sequences, such as EST sequences, are publicly available and accessible through sequence databases. Some of these sequences are related to SEQ ID NO:20 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1432 of SEQ ID NO:20, b is an integer of 15 to 1446, where both a and b correspond to the positions of nucleotide residues shown in SEQ ID NO:20, and where b is greater than or equal to a+14.

Features of Protein Encoded by Gene No: 11

The gene encoding the disclosed cDNA is thought to reside on chromosome 3. Accordingly, polynucleotides related to this invention are useful as a marker in linkage analysis for chromosome 3.

This gene is expressed primarily in fetal tissues, such as liver/spleen and brain, as well as in placental tissue.

Therefore, polynucleotides and polypeptides of the invention are useful as reagents for differential identification of the tissue(s) or cell type(s) present in a biological sample and for the diagnosis of many developmental abnormalities. Similarly, polypeptides and antibodies directed to these polypeptides are useful in providing immunological probes for differential identification of the tissue(s) or cell type(s). For a number of disorders of the above tissues or cells, particularly of the developing fetus, expression of this gene at significantly higher or lower levels may be routinely detected in certain tissues or cell types (e.g. fetal, placental, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in fetal tissues indicates that the protein product of this gene is useful as a growth factor or differentiation factor for particular cell types in the developing fetus and may be useful in replacement or other types of therapy in cases where the gene is expressed aberrantly. Furthermore, the tissue distribution indicates that the protein product of this gene is useful for the diagnosis and/or treatment of disorders of the placenta. Specific expression within the placenta indicates that this gene product may play a role in the proper establishment and maintenance of placental function. Alternately, this gene product may be produced by the placenta and then transported to the embryo, where it may play a crucial role in the development and/or survival of the developing embryo or fetus. Expression of this gene product in a vascular-rich tissue such as the placenta also indicates that this gene product may be produced more generally in endothelial cells or within the circulation. In such instances, it may play more generalized roles in vascular function, such as in angiogenesis. It may also be produced in the vasculature and have effects on other cells within the circulation, such as hematopoietic cells. It may serve to promote the proliferation, survival, activation, and/or differentiation of hematopoietic cells, as well as other cells throughout the body.

Many polynucleotide sequences, such as EST sequences, are publicly available and accessible through sequence databases. Some of these sequences are related to SEQ ID NO:21 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1457 of SEQ ID NO:21, b is an integer of 15 to 1471, where both a and b correspond to the positions of nucleotide residues shown in SEQ ID NO:21, and where b is greater than or equal to a+14.

Features of Protein Encoded by Gene No: 12

One embodiment of this invention is a polypeptide comprising one or more of the following amino acid sequences: ISVLXYPHCVVHELPELTAESLEAGDSN-QFCWRNLFSCINLLRILNKLTKWKHSRT-MMLVVFKSAPILKRALKVKQAMMQLYV-LKLLKVQTKYLGRQWRKSNMKTMSAIYQKVRHRL NDDWAYGNDLDARPWDFQAEECALRANI-ERFNARRYDRAHSNPDFLPVDNCLQSV-LGQRVDLPEDFQMNYDLWLEREVFSKPISWEELL (SEQ ID NO:491), MRAASPPASASDLIEQQQKRGRRE-HKALIKQDNLDAFNERDPYKADDSREEEEENDDD NSLEGETFPLERDEVMPPPLQHPQT-DRLXCPKGLPWXPKVREKDIEMFLESSR-SKFIGYTLGSDTNTVVGLPRPIHESIK-TLKQHKYTSIAEVQAQMEEEYLRSPLSGGEEEVEQVP AETLYQGLLPSLPQYMIALLKILLAAAPTSKAKTDSI NILADVLPEEMPTTVLQSMKLGVDVNRHKEVIV KAISAVLLLLLKHFKLNHVYQFEYMAQHLVFAN CIP-LILKFFNQNIMSYITAKNSISVLDYPHCVV HELPEL-TAESLEAGDSNQFCWRNLFSCINLLRI LNKLTKWKH-SRTMMLVVFKSAPILKRALKVKQA MMQLYVLKLLKVQTKYLGRQWRKSNMKTMSAIY QKVRHRLNDDWAYGNDLDARPWDFQAEECALRA NIERFNARRYDRAHSNPDFLPVDNCLQSVLGQR VDLPEDFQMNYDLWLEREVFSKPISWEELLQ (SEQ ID NO:492), MRAASPPASASDLIEQQQKRGRREHKA-LIKQDNLDAFNERDPYKADDSRE (SEQ ID NO:493), EEEENDDDNSLEGETFPLERDEVMPP-PLQHPQTDRLXCPKGLPWX (SEQ ID NO:494), PKVREKDIEMFLESSRSKFIGYTLGSDT-NTVVGLPRPIHESIKTLKQHKYT (SEQ ID NO:495), SIAEVQAQMEEEYLRSPLSGGEEEVEQV-PAETLYQGLLPSLPQYMIA (SEQ ID NO:496), LLKIL-LAAAPTSKAKTDSINLADVLPEEMPTTV-LQSMKLGVDVNRHK (SEQ ID NO:497), EVIVKAISAVLLLLLKHFKLNHVYQFEY-MAQHLVFANCIPLILKFFNQNI (SEQ ID NO:498), MSYITAKNSISVLDYPHCVVHELPEL-TAESLEAGDSNQFCWRNLFSCI (SEQ ID NO:499), NLLRILNKLTKWKHSRTMMLVVFK-SAPILKRALKVKQAMMQLYVLKL (SEQ ID NO:500), LKVQTKYLGRQWRKSNMKTMSAIYQKVRHRLND DWAYGNDLDARP (SEQ ID NO:501), WDFQAEECAL-RANIERFNARRYDRAHSNPDFLPVDN-CLQSVLGQRVDL (SEQ ID NO:502), and PEDFQMNY-DLWLEREVFSKPISWEELLQ (SEQ ID NO:503). An additional embodiment is the polynucleotides encoding these polypeptides. The translation product of this gene shares sequence homology with a *C. elegans* protein (gi|1086830 coded for by *C. elegans* cDNA yk20f8.5).

This gene is expressed primarily in T-cells, and to a lesser extent in tumor tissue including glioblastoma, meningioma, and Wilm's tumor.

Therefore, polynucleotides and polypeptides of the invention are useful as reagents for differential identification of the tissue(s) or cell type(s) present in a biological sample and for diagnosis of diseases and conditions which include, but are not limited to, diseases of the immune system, including autoimmune conditions such as rheumatoid arthritis, inflammatory disorders and cancer. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 260 as residues: Thr-9 to Ser-14.

The tissue distribution in T-cells indicates that the protein product of this gene is useful for the diagnosis and/or modulation of immune function disorders, including rheumatoid arthritis and inflammatory responses. Furthermore, this gene product may be involved in the regulation of cytokine production, antigen presentation, or other processes that may also suggest a usefulness in the treatment of cancer (e.g. by boosting immune responses). Since the gene is expressed in cells of lymphoid origin, the gene or protein, as well as, antibodies directed against the protein may show utility as a tumor marker and/or immunotherapy targets for the above listed tissues. Expression of this gene product in T cells also strongly indicates a role for this protein in immune function and immune surveillance.

Many polynucleotide sequences, such as EST sequences, are publicly available and accessible through sequence databases. Some of these sequences are related to SEQ ID NO:22 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1388 of SEQ ID NO:22, b is an integer of 15 to 1402, where both a and b correspond to the positions of nucleotide residues shown in SEQ ID NO:22, and where b is greater than or equal to a+14.

Features of Protein Encoded by Gene No: 13

This gene is expressed primarily in placenta, and to a lesser extent in fetal liver and bone marrow.

Therefore, polynucleotides and polypeptides of the invention are useful as reagents for differential identification of the tissue(s) or cell type(s) present in a biological sample and for the diagnosis of hematological disorders. Similarly, polypeptides and antibodies directed to these polypeptides are useful in providing immunological probes for differential identification of the tissue(s) or cell type(s). For a number of disorders of the above tissues or cells, particularly of the hematological and immune systems, expression of this gene at significantly higher or lower levels may be routinely detected in certain tissues or cell types (e.g. placental, immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in fetal liver, and bone marrow indicates that the protein product of this gene is useful as a growth factor for hematapoietic stem cells or progenitor cells in the treatment of chemotherapy patients or kidney disease. Furthermore, the tissue distribution in placenta indicates that the protein product of this gene is useful for the diagnosis and/or treatment of vascular or reproductive disorders. Specific expression within the placenta indicates that this gene product may play a role in the proper establishment and maintenance of placental function. Alternately, this gene product may be produced by the placenta and then transported to the embryo, where it may play a crucial role in the development and/or survival of the developing embryo or fetus. Expression of this gene product in a vascular-rich tissue such as the placenta also indicates that this gene product may be produced more generally in endothelial cells or within the circulation. In such instances, it may play more generalized roles in vascular function, such as in angiogenesis. It may also be produced in the vasculature and have effects on other cells within the circulation, such as hematopoietic cells. It may serve to promote the proliferation, survival, activation, and/or differentiation of hematopoietic cells, as well as other cells throughout the body.

Many polynucleotide sequences, such as EST sequences, are publicly available and accessible through sequence databases. Some of these sequences are related to SEQ ID NO:23 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1033 of SEQ ID NO:23, b is an integer of 15 to 1047, where both a and b correspond to the positions of nucleotide residues shown in SEQ ID NO:23, and where b is greater than or equal to a+14.

Features of Protein Encoded by Gene No: 14

This gene is expressed primarily in stromal cells.

Therefore, polynucleotides and polypeptides of the invention are useful as reagents for differential identification of the tissue(s) or cell type(s) present in a biological sample and for diagnosis of hematapoietic disorders including cancer, neutropenia, anemia, and thrombocytopenia. Similarly, polypeptides and antibodies directed to these polypeptides are useful in providing immunological probes for differential identification of the tissue(s) or cell type(s). For a number of disorders of the above tissues or cells, particularly of the hematapoietic and immune systems, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in stromal cells indicates that the protein product of this gene is useful as a growth factor for hematapoietic stem cells or progenitor cells, in particular following chemotherapy treatment. Furthermore, the tissue distribution indicates that the protein product of this gene is useful for the treatment and diagnosis of hematopoetic related disorders such as anemia, pancytopenia, leukopenia, thrombocytopenia or leukemia, since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types.

Many polynucleotide sequences, such as EST sequences, are publicly available and accessible through sequence databases. Some of these sequences are related to SEQ ID NO:24 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 976 of SEQ ID NO:24, b is an integer of 15 to 990, where both a and b correspond to the positions of nucleotide residues shown in SEQ ID NO:24, and where b is greater than or equal to a+14.

Features of Protein Encoded by Gene No: 15

The translation product of this gene shares sequence homology with epsilon-COP from Bos taurus, which is thought to be important as a component of coatomer, a complex of seven proteins, that is the major component of the non-clathrin membrane coat. One embodiment of this invention is a polypeptide comprising one or more of the following amino acid sequences: MAPPAPGPASGGSGEV-DELFDVKNAFYIGSYQQCIN EAXXVKLSSPERDVER-DVFLYRAYLAQRKFGVVLDE IKPSSAPELQAVRM-FADYLAHESRRDSIVAELDREM SRSXDVTNTTFLLMAASIYLHDQNPDAALRALHQGD SLECTAMTVQILLKLDRLDLARKELKRMQDLDEDAT LTQLATAWVSLATGGEKLQDAYYIIFQEMADKCSPT LLLLNGQAACHMAQGRWEAAE-GLLQEALDKDSGYPE TLVNLIVLSQHLGKPPEVTNR-YLSQLKDAHRSHPFI KEYQAKENDFDRLVLQYAPSA EAGPELSGP(SEQ ID NO:504), RDVERDVFLYRAY-LAQRKFGVVLDEIKPSSAPELQAVRM-FADYLAHESRRDSIVAELDREMSRSXD-VTNTTFLLMAASIYLHDQNPDAALRALHQGDSLECT AMTVQILLKLDRLDLARKELKRMQDLDEDATLTQLA TAWVSLATGGEKLQDAYYIFQEMADKCSPTLLLLNG QAACHMAQGRWEAAEGLLQEALDKDSGY-PETLVNLI VLSQHLGKPPEVTNRYLSQLKDAHRSH-PFIKEYQAK ENDFDRLVLQYAPSA (SEQ ID NO:505), MAPPAPGPASGGSGEVDELFD-VKNAFYIGSYQQCINEAXXVKLSSPER (SEQ ID NO:506), DVERDVFLYRAYLAQRKFGVVL-DEIKPSSAPELQAVRMFADYLAHES (SEQ ID NO:507), RRDSIVAELDREMSRSXDVTNTTFLL-MAASIYLHDQNPDAALRALHQG (SEQ ID NO:508), DSLECTAMTVQILLKLDRLDLAR-KELKRMQDLDEDATLTQLATAWVS (SEQ ID NO:509), LATGGEKLQDAYYIFQEMADKC-SPTLLLLNGQAACHMAQGRWEAAEG (SEQ ID NO:510), LLQEALDKDSGYPETLVNLIVLSQHLGK-PPEVTNRYLSQLKDAHRSHP (SEQ ID NO:51 1), FIKEYQAKENDFDRLVLQYAPSAEAGPELSGP (SEQ ID NO:512), RDVERDVFLYRAYLAQRKFGVVL-DEIKPSSAPELQAVRMFADYLAHE (SEQ ID NO:513), SRRDSIVAELDREMSRSXDVTNTTFLL-MAASIYLHDQNPDAALRALHQ (SEQ ID NO:514), GDSLECTAMTVQILLKLDRLDLAR-KELKRMQDLDEDATLTQLATAWV (SEQ ID NO:515), SLATGGEKLQDAYYIFQEMADKC-SPTLLLLNGQAACHMAQGRWEAAE (SEQ ID NO:516), GLLQEALDKDSGYPETLVNLIV-LSQHLGKPPEVTNRYL (SEQ ID NO:517), SQLKDAHRSHPFIKEYQAKENDFDRLVLQYAPSA (SEQ ID NO:518), or NRYYRESWSLQVPVRNSGST-HASERNGASGPRPGLRRLRGGRRAVRRK-ERLLHRQLPAVHKR (SEQ ID NO:519). An additional embodiment is the polynucleotides encoding these polypeptides. The gene encoding the disclosed cDNA is thought to reside on chromosome 19. Accordingly, polynucleotides of the invention are useful as a marker in linkage analysis for chromosome 19.

This gene is expressed primarily in activated monocytes and T-cells.

Therefore, polynucleotides and polypeptides of the invention are useful as reagents for differential identification of the tissue(s) or cell type(s) present in a biological sample and for diagnosis of diseases and conditions which include, but are not limited to, immunomodulation, specifically relating to transport problems in these cells. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in activated monocytes and T-cells combined with the homology to epsilon-COP indicates that the protein product of this gene is useful for treating and/or diagnosing problems with the cellular transport of proteins that may result in immunologic dysfunction. Furthermore, this gene product may be involved in the regulation of cytokine production, antigen presentation, or other processes that may also suggest a usefulness in the treatment of cancer (e.g. by boosting immune responses). Since the gene is expressed in cells of lymphoid origin, the gene or protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:25 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1194 of SEQ ID NO:25, b is an integer of 15 to 1208, where both a and b correspond to the positions of nucleotide residues shown in SEQ ID NO:25, and where b is greater than or equal to a+14.

Features of Protein Encoded by Gene No: 16

The translation product of this gene shares sequence homology with an RNA helicase which is thought to be important in polynucleotide metabolism. The translation product of this contig exhibits good homology to the LbeIF4A antigen of *Leishmania braziliensis*. The LbeIF4A antigen, or immunogenic portions of it, can be used to induce protective immunity against leishmaniasis, specifically *L. donovani, L. chagasi, L. infantum, L. major, L. braziliensis, L. panamensis, L. tropica* and *L. guyanensis*. It can also be used diagnostically to detect Leishmania infection or to stimulate a cellular and/or humoral immune response or to stimulate the production of interleukin-12. The gene encoding the disclosed cDNA is thought to reside on chromosome 7. Accordingly, polynucleotides related to this invention are useful as a marker in linkage analysis for chromosome 7.

This gene is expressed primarily in colon cancer, and to a lesser extent, in pituitary.

Therefore, polynucleotides and polypeptides of the invention are useful as reagents for differential identification of the tissue(s) or cell type(s) present in a biological sample and for diagnosis of cancers particularly of the colon. Similarly, polypeptides and antibodies directed to these polypeptides are useful in providing immunological probes for differential identification of the tissue(s) or cell type(s). For a umber of disorders of the above tissues or cells, particularly of the gastrointestinal system, expression of this gene at significantly higher or lower levels may be routinely detected in certain tissues or cell types (e.g. colon, pituitary, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 264 as residues: Glu-93 to Ala-98, Gln-150 to Leu-156, Leu-220 to Leu-231, Leu-268 to Arg-273, Val-324 to Pro-341, Arg-372 to Asn-380, Ser-405 to Gly-410, Phe-426 to Ala-433, Glu-458 to Asp-470, and/or Arg-506 to Ser-547.

The tissue distribution in colon cancer, combined with the homology to RNA helicase indicates that the protein product of this gene is useful for the development of diagnostic tests for colon cancer or other gastrointestinal or metabolic disorders. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:26 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1908 of SEQ ID NO:26, b is an integer of 15 to 1922, where both a and b correspond to the positions of nucleotide residues shown in SEQ ID NO:26, and where b is greater than or equal to a+14.

Features of Protein Encoded by Gene No: 17

The translation product of this contig has sequence homology to a cytoplasmic protein that binds specifically to JNK, designated the JNK interacting protein-1 or JIP-1 in Mus musculus. JIP-1 caused cytoplasmic retention of JNK and inhibition of JNK-regulated gene expression. The gene encoding the disclosed cDNA is thought to reside on chromosome 11. Accordingly, polynucleotides related to this invention are useful as a marker in linkage analysis for chromosome 11. An embodiment of the invention is a polypeptide comprising one or more of the following amino acid sequences: APGXGWRGSLGEPPPPPRASLSSDT-SALSYDSVKYTLVVDEHAQLELVSLR-RASETTVTRVTLPPS (SEQ ID NO:520), APGXG-WRGSLGEPPPPPRASLSSDTSALSY (SEQ ID NO:521), or DSVKYTLVVDEHAQLELVSLRRA-SETTVTRVTLPPS (SEQ ID NO:522). An additional embodiment is the polynucleotides encoding these polypeptides.

This gene is expressed primarily in brain, including pituitary, cerebellum, frontal cortex, and fetal brain, and to a lesser extent in the cortex or the kidney.

Therefore, polynucleotides and polypeptides of the invention are useful as reagents for differential identification of the tissue(s) or cell type(s) present in a biological sample and for diagnosis of the central nervous system disorders including ischemia, epilepsy, Parkinson's disease, and schizophrenia. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues or cell types (e.g. brain, kidney, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder. Futhermore, the translation product of this contig may suppress the effects of the JNK signaling pathway on cellular proliferation, including transformation by the Bcr-Abl oncogene.

Preferred epitopes include those comprising a sequence shown in SEQ ID NO: 265 as residues: Pro-6 to Ser-26, Ala-30 to Asp-41, Gly-55 to Ser-61, Gly-74 to Thr-80, Tyr-1 17 to Ala-123, Tyr-167 to Asp-172, Ala-212 to Cys-223, and/or Pro-239 to Tyr-244.

The tissue distribution in brain indicates that the protein product of this gene is useful for the enhanced survivial and/or differentiation of neurons as a treatment for neurodegenerative disease. Furthermore, the tissue distribution indicates that the translation product of this gene may be involved in neuronal survival; synapse formation; conductance; neural differentiation, etc. Such involvement may impact many processes, such as learning and cognition. It may also be useful in the treatment of such neurodegenerative disorders as schizophrenia; ALS; or Alzheimer's.

Many polynucleotide sequences, such as EST sequences, are publicly available and accessible through sequence databases. Some of these sequences are related to SEQ ID NO:27 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1937 of SEQ ID NO:27, b is an integer of 15 to 1951, where both a and b correspond to the positions of nucleotide residues shown in SEQ ID NO:27, and where b is greater than or equal to a+14.

Features of Protein Encoded by Gene No: 18

The translation product of this gene shares sequence homology with a liver stage antigen from a protozoan parasite.

This gene is expressed primarily in fetal tissue, and to a lesser extent, in activated T-cells and other immune cells.

Therefore, polynucleotides and polypeptides of the invention are useful as reagents for differential identification of the tissue(s) or cell type(s) present in a biological sample and for diagnosis of diseases and conditions which include, but are not limited to, developmental abnormalities and diseases of immune function. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in T-cells, combined with the homology to a protozoan antigen indicates that the protein product of this gene is useful for the treatment and/or immune modulation of parasitic infections. Furthermore, expression of this gene product in T cells also strongly indicates a role for this protein in immune function and immune surveillance.

Many polynucleotide sequences, such as EST sequences, are publicly available and accessible through sequence databases. Some of these sequences are related to SEQ ID NO:28 and may have been publicly available prior to conception of the present invention. Preferably, such related polynucleotides are specifically excluded from the scope of the present invention. To list every related sequence is cumbersome. ccordingly, preferably excluded from the present invention are one or more polynucleotides comprising a nucleotide sequence described by the general formula of a–b, where a is any integer between 1 to 3975 of SEQ ID NO:28, b is an integer of 15 to 3989, where both a and b correspond to the positions of nucleotide residues shown in SEQ ID NO:28, and where b is greater than or equal to a+14.

Features of Protein Encoded by Gene No: 19

One embodiment of the invention is a polypeptide comprising one or more of the following amino acid sequences: MKAIGIEPSLATYHHIIRLFDQPGD-PLKRSSFIIYDIMNELMGKRFSPKDPD-DDKFFQSAMSICSSLRDLELAYQVH-GLLKTGDNWKFIGPDQHRNFYYSKFFDLICLMEQIDV TLKWYEDLIPSAYFPHSQTMIHLLQALDVANRLEVIP KIWER (SEQ ID NO:523), KDSKEYGHTFRSDLREE-ILMLMARDKHPPELQVAFADCAADIKSAYESQPIRQ TAQDWPATSLNCIAILFLRAGRTQEAWKMLGLF RKHNKIPRSELLNELMDSAKVSNSPSQAIEVVELAS AFSLPICEGLTQRVMSDFAINQEQKEAL-SNLTALTSDSDTDSSSDSDSDTSEGK (SEQ ID NO:524), MKAIGIEPSLATYHHIIRLFDQPGD-PLKRSSFIIYDIMNELMGKRFSPK (SEQ ID NO:525), DPDDDKFFQSAMSICSSLRDLELAYQVH-GLLKTGDNWKFIGPDQHRNFY (SEQ ID NO:526), YSKFFDLICLMEQIDVTLKWYEDLIPSA (SEQ ID NO:527), YFPHSQTMIHLLQALDVANRLEVIPKIWER (SEQ ID NO:528), KDSKEYGHTFRSDLREEILML-MARDKHPPELQVAFADCAADIKSAY (SEQ ID NO:529), ESQPIRQTAQDWPATSLNCIAILFLRA-GRTQEAWKMLGLFRKHNKIPRSE (SEQ ID NO:530), LLNELMDSAKVSNSPSQAIEVVELASAF-SLPICEGLTQRVMSDFAIN (SEQ ID NO:531), or QEQKEALSNLTALTSDSDTDSSSDSDSDTSEGK (SEQ ID NO:532). An additional embodiment is the polynucleotides encoding these polypeptides. The gene encoding the disclosed cDNA is thought to reside on chromosome 2. Accordingly, polynucleotides related to this invention are useful as a marker in linkage analysis for chromosome 2.

This gene is expressed primarily in stromal and CD34 depleted bone marrow cells, and to a lesser extent in tissues of embryonic origin.

Therefore, polynucleotides and polypeptides of the invention are useful as reagents for differential identification of the tissue(s) or cell type(s) present in a biological sample and for diagnosis of diseases and conditions which include, but are not limited to, diseases of hematologic origin including cancers and immune dysfunction. Similarly, polypeptides and antibodies directed to these polypeptides are useful in providing immunological probes for differential identification of the tissue(s) or cell type(s). For a number of disorders of the above tissues or cells, particularly of the hematapoietic and immune systems, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 267 as residues: Ser-28 to Gln-34.

The tissue distribution in stromal and CD34 depleted bone marrow cells indicates that the protein product of this gene is useful as a growth factor for hematopoietic stem cells or progenitor cells which may be useful in the treatment of chemotherapy patients suffering from neutropenia. Furthermore, the tissue distribution indicates that the protein product of this gene is useful for the treatment and diagnosis of hematopoetic related disorders such as anemia, pancytopenia, leukopenia, thrombocytopenia or leukemia, since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types.

Many polynucleotide sequences, such as EST sequences, are publicly available and accessible through sequence databases. Some of these sequences are related to SEQ ID NO:29 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 3721 of SEQ ID NO:29, b is an integer of 15 to 3735, where both a and b correspond to the positions of nucleotide residues shown in SEQ ID NO:29, and where b is greater than or equal to a+14.

Features of Protein Encoded by Gene No: 20

One embodiment of this invention is a polypeptide comprising one or more of the following amino acid sequences: MSSDNESDIEDEDLKLELRRLRD-KHLKEIQDLQSRQKHEIESLYTKLGKVP-PAVIIPPAAPLSGRRRRPTKSKG-SKSSRSSSLGNKSPQLSGNLSGQSAASVLHPQQTLH PPGNIPESGQNQLLQPLKPSPSSDNLYSAFTSDGAI SVPSLSAPGQGTSSTNTVGATVNSQAAQAQPPAMTS SRKGTFTDDLHKLVDNWARDAMNLSGR-RGSKGHMNY EGPGMARKFSAPGQLCISMTSN-LGGSAPISAASATS LGHFTKSMCPPQQYGFPATPF-GAQWSGTGGPAPQPL GQFQPVGTASLQNFNISNLQKSISNPPGSNLRTT (SEQ ID NO:533), IQDLQSRQKHEIESLYTKLGKVPPAVI-IPPAAPLSGRRRRPTKSKGSKSSRSSS-LGNKSPQLSGNLSGQSAASVLHPQQTLH-PPGNIPESGQNQLLQPLKPSPSSDNLYSAFTSDGAI SVPSLSAPGQGTSST (SEQ ID NO:534), TSDGAIS-VPSLSAPGQGTSSTNTVGATVN-SQAAQAQPPAMTSSRKGTFTDDLH (SEQ ID NO:535), KGHMNYEGPGMARKFSAPGQLCISMTSN-LGGSAPISAASATSLGHFTK (SEQ ID NO:536), QPLKPSPSSDNLYSAFTSDGAISVPSLSAPG (SEQ ID NO:537), MSSDNESDIEDEDLKLELRRLRD-KHLKEIQDLQSRQKHEIESLYTKLGKVP (SEQ ID NO:538), PAVIIPPAAPLSGRRRRPTKSKG-SKSSRSSSLGNKSPQLSGNLSGQS (SEQ ID NO:539), AASVLHPQQTLHPPGNIPESGQNQLLQ-PLKPSPSSDNLYSAFTSDGAISV (SEQ ID NO:540), PSLSAPGQGTSSTNTVGATVN-SQAAQAQPPAMTSSRKGTFTDDL (SEQ ID NO:541), HKLVDNWARDAMNLSGRRGSKGHMNYEG-PGMARKFSAPGQLCISMT (SEQ ID NO:542), SNLGGSAPISAASATSLGHFTKSMCP-PQQYGFPATPFGAQWSGTGG (SEQ ID NO:543), and PAPQPLGQFQPVGTASLQNFNISNLQK-SISNPPGSNLRTT (SEQ ID NO:544). Additional embodiments is the polynucleotides encoding these polypeptides.

This gene is expressed in fetal liver and tissues associated with the CNS.

Therefore, polynucleotides and polypeptides of the invention are useful as reagents for differential identification of the tissue(s) or cell type(s) present in a biological sample and for diagnosis of diseases and conditions which include, but are not limited to, liver and CNS diseases. Similarly, polypeptides and antibodies directed to these polypeptides are useful in providing immunological probes for differential identification of the tissue(s) or cell type(s). For a number of disorders of the above tissues or cells, particularly of the liver and CNS, expression of this gene at significantly higher or lower levels may be routinely detected in certain tissues or cell types (e.g. liver, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 268 as residues: Gln-26 to Lys-34.

The tissue distribution in fetal liver and neural tissues indicates that the protein product of this gene is useful for the diagnosis and treatment for liver diseases such as hepatocellular carcinomas and diseases of the CNS. Furthermore, the tissue distribution indicates that the protein product of this gene is useful for the detection and treatment of liver disorders and cancers (e.g. hepatoblastoma, jaundice, hepatitis, liver metabolic diseases and conditions that are attributable to the differentiation of hepatocyte progenitor cells), as well as the detection and treatment of neurodegenerative disease states and behavioural disorders such as Alzheimers Disease, Parkinsons Disease, Huntingtons Disease, Tourette Syndrome, schizophrenia, mania, dementia, paranoia, obsessive compulsive disorder, panic disorder, learning disabilities, ALS, psychoses, autism, and altered bahaviors, including disorders in feeding, sleep patterns, balance, and perception.

Many polynucleotide sequences, such as EST sequences, are publicly available and accessible through sequence databases. Some of these sequences are related to SEQ ID NO:30 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1653 of SEQ ID NO:30, b is an integer of 15 to 1667, where both a and b correspond to the positions of nucleotide residues shown in SEQ ID NO:30, and where b is greater than or equal to a+14.

Features of Protein Encoded by Gene No: 21

The translation product of this gene shows sequence homology to two recently gened genes, karyopherin beta 3 and Ran_GTP binding protein 5. (See Genbank Accession Nos. gi|2102696 and gnl|PID|e328731.) The Ran_GTP binding protein is related to importin-beta, the key mediator of nuclear localization signal (NLS)-dependent nuclear transport. Based on homology, it is likely that this gene may demonstrate activity similar to the RAN_GTP binding protein. One embodiment of this invention is a polypeptide comprising the following amino acid sequence: VRVAAAESMXLLLECAXVRGPEYLTQM-WHFMCDALIKAIGTEPDSDVLSEIMHSFAK (SEQ ID NO:545). An additional embodiment is the polynucleotides encoding these polypeptides.

This gene is expressed in thymus tissue, and to a lesser extent in stromal cells.

Therefore, polynucleotides and polypeptides of the invention are useful as reagents for differential identification of the tissue(s) or cell type(s) present in a biological sample and for diagnosis of diseases and conditions which include, but are not limited to, immune disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, thymus, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in thymus indicates that the protein product of this gene is useful for the diagnosis and treatment for immune disorders. Furthermore, the polypeptides or polynucleotides of the present invention are also useful in the treatment, prophlaxis, and detection of thymus disorders, such as Graves Disease, lymphocytic thyroiditis, hyperthyroidism, and hypothyroidism. Additionally, the tissue distribution indicates that the protein product of this gene is useful for the treatment and diagnosis of hematopoetic related disorders such as anemia, pancytopenia, leukopenia, thrombocytopenia or leukemia, since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types.

Many polynucleotide sequences, such as EST sequences, are publicly available and accessible through sequence databases. Some of these sequences are related to SEQ ID NO:31 and may have been publicly available prior to conception of the present invention. Preferably, such related polynucleotides are specifically excluded from the scope of the present invention. To list every related sequence is cumbersome.

Accordingly, preferably excluded from the present invention are one or more polynucleotides comprising a nucleotide sequence described by the general formula of a–b, where a is any integer between 1 to 1394 of SEQ ID NO:31, b is an integer of 15 to 1408, where both a and b correspond to the positions of nucleotide residues shown in SEQ ID NO:31, and where b is greater than or equal to a+14.

Features of Protein Encoded by Gene No: 22

The translation product of this gene shares sequence homology with a natural resistance-associated macrophage protein 2 from *Homo sapiens* (gi|3152690 (AF064484)), which is thought to function as a macrophage-specific membrane transport protein. This gene is expressed primarily in prostate and osteoclastoma tissues. One embodiment of this invention is a polypeptide comprising one ore more of the following amino acid sequences: MEINNQNCFIVIDLVRTVMENGVEGLLIFGAFLPESWLIGVRCSSEPPKALLLILAHSQKRRLDGWSFIRHLRVHYCVSLTIHFS (SEQ ID NO:546), GGREANKXFFIESCIALFVSFIINVFVVSVFAEXFFGXTNEQVVEVCTNTSSPHAGLFPKDNSTLAVDIYKGGVVLGCYFGPAALYIWAVGILAAGQSST (SEQ ID NO:547), GGREANKXFFIESCIALFVSFIINVFVVSVFAEXFFGXTNEQVVE (SEQ ID NO:548), and/or VCTNTSSPHAGLFPKDNSTLAVDIYKGGVVLGCYFGPAALYIWAVGILAAGQSST (SEQ ID NO:549). Additional embodiments is the polynucleotides encoding these polypeptides. The gene encoding the disclosed cDNA is thought to reside on chromosome 12. Accordingly, polynucleotides related to this invention are useful as a marker in linkage analysis for chromosome 12.

This gene is expressed primarily in fetal liver/spleen, fetal brain, and to a lesser extent in placenta.

Therefore, polynucleotides and polypeptides of the invention are useful as reagents for differential identification of the tissue(s) or cell type(s) present in a biological sample and for diagnosis of diseases and conditions which include, but are not limited to, immune, developmental, hepatic, or bone and prostate diseases, and cancers, particularly of the bone and prostate. Similarly, polypeptides and antibodies directed to these polypeptides are useful in providing immunological probes for differential identification of the tissue(s) or cell type(s). For a number of disorders of the above tissues or cells, particularly of the bone and prostate systems, expression of this gene at significantly higher or lower levels may be routinely detected in certain tissues or cell types (e.g. bone, prostate, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in bone indicates that the protein product of this gene is useful for the diagnosis and treatment of bone and prostate disorders, especially cancers of those systems. Elevated levels of expression of this gene product in osteoclastoma indicates that it may play a role in the survival, proliferation, and/or growth of osteoclasts. Therefore, it may be useful in influencing bone mass in such conditions as osteoporosis. Moreover, the protein product of this gene is useful for the treatment and diagnosis of hematopoietic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:32 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 3172 of SEQ ID NO:32, b is an integer of 15 to 3186, where both a and b correspond to the positions of nucleotide residues shown in SEQ ID NO:32, and where b is greater than or equal to a+14.

Features of Protein Encoded by Gene No: 23

This gene shares sequence homology with the FK506-binding protein (FKBP-13) family, a known cytosolic receptor for the immunosuppressants FK506 and rapamycin. Recently, another group has gened a very similar gene, recognizing the homology to the FK506-binding protein family, calling their gene FKBP23 (See Genbank Accession No. 2827255.). Contact of cells with supernatant expressing the product of this gene increases the permeability of both prostate stromal cells and dermal fibroblasts to calcium. Thus, it is likely that the product of this gene is involved in a signal transduction pathway that is initiated when the product of this gene binds receptors on the surface of stromal cells and dermal fibroblast cells. Thus, polynucleotides and polypeptides have uses which include, but are not limited to, activating stromal and fibroblast cells.

This gene is expressed primarily in lymphoid tissues and stromal cells.

Therefore, polynucleotides and polypeptides of the invention are useful as reagents for differential identification of the tissue(s) or cell type(s) present in a biological sample, especially for those susceptible to immune suppressant therapies and for diagnosis of diseases and conditions which include, but are not limited to, immune suppressant disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 271 as residues: Ala-19 to Val-31, Arg-38 to Gly-49, Ala-61 to Lys-66, Tyr-68 to Pro-78, Gly-116 to Ala-121, Asp-154 to Ser-162, Glu-173 to Gln-186, Phe-194 to Gly-203, and/or Pro-207 to Val-212.

The tissue distribution in lymphoid tissues and stromal cells, the biological activity data, combined with the homology to FKBP-12 and -13 indicates that the protein product of this gene is useful for the diagnosis and treatment of immune suppressant disorders.

Many polynucleotide sequences, such as EST sequences, are publicly available and accessible through sequence databases. Some of these sequences are related to SEQ ID NO:33 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 957 of SEQ ID NO:33, b is an integer of 15 to 971, where both a and b correspond to the positions of nucleotide residues shown in SEQ ID NO:33, and where b is greater than or equal to a+14.

Features of Protein Encoded by Gene No: 24

The gene encoding the disclosed cDNA is thought to reside on chromosome 8. Accordingly, polynucleotides related to this invention are useful as a marker in linkage analysis for chromosome 8.

This gene is expressed primarily in the brain and in the retina.

Therefore, polynucleotides and polypeptides of the invention are useful as reagents for differential identification of the tissue(s) or cell type(s) present in a biological sample and for diagnosis of diseases and conditions which include, but are not limited to, neurological and ocular associated disease states. Similarly, polypeptides and antibodies directed to these polypeptides are useful in providing immunological probes for differential identification of the tissue(s) or cell type(s). For a number of disorders of the above tissues or cells, particularly of the disorders of the central nervous system, expression of this gene at significantly higher or lower levels may be routinely detected in certain tissues or cell types (e.g. brain, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 272 as residues: Cys-34 to Asp-40.

The tissue distribution in retina indicates that the protein product of this gene is useful for the treatment and/or detection of eye disorders including blindness, color blindness, impaired vision, short and long sightedness, retinitis pigmentosa, retinitis proliferans, and retinoblastoma. Expression in the brain indicates a role in the is useful for the detection/treatment of neurodegenerative disease states and behavioural disorders such as Alzheimer's Disease, Parkinson's Disease, Huntington's Disease, schizophrenia, mania, dementia, paranoia, obsessive compulsive disorder and panic disorder.

Many polynucleotide sequences, such as EST sequences, are publicly available and accessible through sequence databases. Some of these sequences are related to SEQ ID NO:34 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1778 of SEQ ID NO:34, b is an integer of 15 to 1792, where both a and b correspond to the positions of nucleotide residues shown in SEQ ID NO:34, and where b is greater than or equal to a+14.

Features of Protein Encoded by Gene No: 25

This gene shows sequence homology to a newly identified class of proteins expressed in the nervous system, called stathmin family. (See Genbank Accession No. 2585991; see also Eur. J. Biochem. 248 (3), 794–806 (1997).) The stathmin family appears to be an ubiquitous phosphoprotein involved as a relay integrating various intracellular signaling pathways. These pathways affect cell proliferation and differentiation. One embodiment of the invention is a polypeptide comprising one or both of the following amino acid sequences: QDKHAEEVRKNKELKEEASR (SEQ ID NO:550), QQDLSPWAAPVGCPLXXASXTCHXLPLS-GCLRRQSXSLPVVAXLCFWF SCPLASLFVPGQPCVTCPFPSLPFQD-KHAEEVRKNKELKEEASR (SEQ ID NO:551). An additional embodiment is the polynucleotides encoding these polypeptides.

This gene is expressed highly in brain tissues.

Therefore, polynucleotides and polypeptides of the invention are useful as reagents for differential identification of the tissue(s) or cell type(s) present in a biological sample and for diagnosis of diseases and conditions which include, but are not limited to, neurological disorders. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues or cell types (e.g. brain, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in brain indicates that the protein product of this gene is useful for the detection/treatment of neurodegenerative disease states and behavioural disorders such as Alzheimers Disease, Parkinsons Disease, Huntintons Disease, schizophrenia, mania, dementia, paranoia, obsessive compulsive disorder and panic disorder.

Many polynucleotide sequences, such as EST sequences, are publicly available and accessible through sequence databases. Some of these sequences are related to SEQ ID NO:35 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 882 of SEQ ID NO:35, b is an integer of 15 to 896, where both a and b correspond to the positions of nucleotide residues shown in SEQ ID NO:35, and where b is greater than or equal to a+14.

Features of Protein Encoded by Gene No: 26

The polynucleotide sequence of this gene contains a domain similar to a Flt3 ligand peptide. One embodiment of the invention is a polypeptide comprising the following amino acid sequence: PTRCCTTQPCRSSARRPCWVPM-VPSPEGREXQPTCPS (SEQ ID NO:552). An additional embodiment is the polynucleotides encoding these polypeptides. Thus, this gene may have activity as binding to Flt3 receptors, a process known to promote angiogenesis and/or lymphangiogenesis.

This gene is expressed in human tonsil, and to a lesser extent in teratocarcinoma, placenta, colon carcinoma, and fetal kidney.

Therefore, polynucleotides and polypeptides of the invention are useful as reagents for identification of the tissue(s) or cell type(s) present in a biological sample and for diagnosis of diseases and conditions which include, but are not limited to, diseases of the tonsil, as well as cancers, such as colon, reproductive, and kidney cancers. Similarly, polypeptides and antibodies directed to these polypeptides are useful in providing immunological probes for differential identification of the tissue(s) or cell type(s). For a number of disorders of the above tissues or cells, particularly of the tonsils, colon, reproductive organs, and kidneys, expression of this gene at significantly higher or lower levels may be routinely detected in certain tissues or cell types (e.g. immune, tonsils, colon, kidney, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 274 as residues: Pro-22 to Glu-33.

The tissue distribution in tonsils, several cancers, and fetal tissues indicates that the protein product of this gene is useful for the diagnosis and treatment of diseases of the tonsil or colon, such as tonsilitis, inflammatory diseases involving nose and paranasal sinuses, especially during the infection of influenza, adenoviruses, parainfluenza, or rhinoviruses, for example. The gene may also be useful in the diagnosis and treatment of neoplasms of nasopharynx or colon origins. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:36 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 898 of SEQ ID NO:36, b is an integer of 15 to 912, where both a and b correspond to the positions of nucleotide residues shown in SEQ ID NO:36, and where b is greater than or equal to a+14.

Features of Protein Encoded by Gene No: 27

One embodiment of the invention is a polypeptide comprising one or of the following amino acid sequences: MKRSLNENSARSTAGCLPVPLFNQKKRN-RQPLTSNPLKDDSGISTPSDNYDFP-PLPTDWAWEAVNPEXAPVMKTVDTG-QIPHSVSRPLRSQDSVFNSIQSNTGRSQGGWSYRDG NKNTSLKTWXKNDFKPQCKRTNL-VANDGKNSCPMSS GAQQQKQLRTPEPPNLSRNKE-TELLRQTHSSKISGC TMRGLDKNSALQTLKPN-FQQNQYKXQMLDDIPEDNT LKETSLYQLQFKEKASSLRIISAVIESMKYWREHAQ KTVLLFEVLAVLDSAVTPGPYYSKTFLMRDGKNTLP CVFYEIDRELPRLIRGRVHRCVGNYDQKKNIFQCVS VRPASVSEQKTFQAFVKIADVEMQYYINVNET (SEQ ID NO:553), SQDSVFNSIQSNTGRSQGG-WSYRDGNKNTSLKTWXKNDFKPQCKR (SEQ ID NO:554), NKETELLRQTHSSKISGCTMRGLDKN-SALQTLKPNF (SEQ ID NO:555), SSLRIISAVIESMKY-WREHAQKTVLLFEVLAVLDSAVTPGPYYSKTFLM (SEQ ID NO:556), and/or PRLIRGRVHRCVGNY-DQKKNIFQCVSVRPASVSEQKTFQAFV (SEQ ID NO:557). An additional embodiment is the polynucleotides encoding these polypeptides.

This gene is expressed primarily in human testes.

Therefore, polynucleotides and polypeptides of the invention are useful as reagents for differential identification of the tissue(s) or cell type(s) present in a biological sample and for diagnosis of diseases and conditions which include, but are not limited to, male reproductive disorders, including cancer. Similarly, polypeptides and antibodies directed to these polypeptides are useful in providing immunological probes for differential identification of the tissue(s) or cell type(s). For a number of disorders of the above tissues or cells, particularly of the male reproductive system, expression of this gene at significantly higher or lower levels may be routinely detected in certain tissues or cell types (e.g. testes, cancerous and wounded tissues) or bodily fluids (e.g. lymph, serum, seminal fluid, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in human testes indicates that the protein product of this gene is useful as a hormone with reproductive or other systemic functions; contraceptive development; male infertility of testicular causes, such as Kleinfelter's syndrome, varicocele, orchitis; male sexual dysfunctions; testicular neoplasms; and inflammatory disorders such as epididymitis. Furthermore, this gene product is useful in the treatment of male infertility and/or impotence. This gene product is also useful in assays designed to identify binding agents as such agents (antagonists) are useful as male contraceptive agents. Similarly, the protein is believed to by useful in the treatment and/or diagnosis of testicular cancer. The testes are also a site of active gene expression of transcripts that may be expressed, particularly at low levels, in other tissues of the body. Therefore, this gene product may be expressed in other specific tissues or organs where it may play related functional roles in other processes, such as hematopoiesis, inflammation, bone formation, and kidney function, to name a few possible target indications.

Many polynucleotide sequences, such as EST sequences, are publicly available and accessible through sequence databases. Some of these sequences are related to SEQ ID NO:37 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1368 of SEQ ID NO:37, b is an integer of 15 to 1382, where both a and b correspond to the positions of nucleotide residues shown in SEQ ID NO:37, and where b is greater than or equal to a+14.

Features of Protein Encoded by Gene No: 28

This gene is expressed primarily in apoptotic T-cell.

Therefore, polynucleotides and polypeptides of the invention are useful as reagents for differential identification of the tissue(s) or cell type(s) present in a biological sample and for diagnosis of diseases and conditions which include, but are not limited to, diseases relating to T cells, as well as cancer in general. Similarly, polypeptides and antibodies directed to these polypeptides are useful in providing immunological probes for differential identification of the tissue(s) or cell type(s). For a number of disorders of the above tissues or cells, particularly of the disorders of the immune system, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in apoptotic T-cells indicates that the protein product of this gene is useful for the detection and/or treatment of disorders of the immune system. Moreover, since the gene was isolated from an apoptotic cell, and based on the understanding of the relationship of apoptosis and cancer, it is likely that this gene may play a role in the genesis of cancer. Furthermore, expression of this gene product in T cells also strongly indicates a role for this protein in immune function and immune surveillance.

Many polynucleotide sequences, such as EST sequences, are publicly available and accessible through sequence databases. Some of these sequences are related to SEQ ID NO:38 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 858 of SEQ ID NO:38, b is an integer of 15 to 872, where both a and b correspond to the positions of nucleotide residues shown in SEQ ID NO:38, and where b is greater than or equal to a+14.

Features of Protein Encoded by Gene No: 29

This gene is expressed primarily in human tonsils.

Therefore, polynucleotides and polypeptides of the invention are useful as reagents for differential identification of the tissue(s) or cell type(s) present in a biological sample and for diagnosis of diseases and conditions which include, but are not limited to, gastrointestinal and immune disorders. Similarly, polypeptides and antibodies directed to these polypeptides are useful in providing immunological probes for differential identification of the tissue(s) or cell type(s). For a number of disorders of the above tissues or cells, particularly of the gastrointestinal and immune system, expression of this gene at significantly higher or lower levels may be routinely detected in certain tissues or cell types (e.g. inmmune, gastrointestinal, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in human tonsils indicates that the protein product of this gene is useful for the diagnosis and treatment of gastrointestinal diseases. Alternatively, the tissue distribution indicates that the protein product of this gene is useful for the diagnosis and treatment of a variety of immune system disorders. Expression of this gene product in tonsils indicates a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the gene or protein, as well as, antibodies directed against the protein may show utility as a tumor marker and/or immunotherapy targets for the above listed tissues. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:39 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 798 of SEQ ID NO:39, b is an integer of 15 to 812, where both a and b correspond to the positions of nucleotide residues shown in SEQ ID NO:39, and where b is greater than or equal to a+14.

Features of Protein Encoded by Gene No: 30

The translation product of this gene shares sequence homology with C44C1.2 gene product of *Caenorhabditis elegans*. One embodiment of the invention is a polypeptide comprising one or more of the following amino acid sequences: GVFRPCVCGRPASLTCSPLDPEVGPY-CDTPTMRTLFNLLWLALACSPVHTTL-SKSDAKKAASKTLLEKSQFSDKPVQDRGLVVTDLKA ESVVLEHRSYCSAKARDRHFAGDV-LGYVTPWNSHGY DVTKVFGSKFT-QISPVWLQLKRRGREMFEVTGLHDV DQGWM-RAVRKHAKGLHIVPRLLFEDWTYDDFRNVLD SEDEIEELSKTVVQVAKNQHFDGFVVEVWNQLLSQK RVGLIHMLTHLAEALHQARLLALLVIPPAITPGTDQ LGMFTHKEFEQLAPVLDGFSLMTYDYSTAHQPGPNA PLSWVRACVQVLDPKXKWRTKSS-WGSTSMXWTXRXP XDARXPVVGXRXIQXLKDHX-PRMVLDSKPQ (SEQ ID NO:558), TCSPLDPEVGPY-CDTPTMRTLFNLLWLALACSPVHTTLS (SEQ ID NO:559), LVVTDLKAESVVLEHRSYCSAKARDRHF-AGDVLGYVTPWNSHGYDVTKVFGSKF (SEQ ID NO:560), REMFEVTGLHDVDQGWMRAVRKHAKGL-HIVPRLLFEDWTYDDFRNVLDSEDE (SEQ ID NO:561), HFDGFVVEVWNQLLSQKRVGLIHMLTH-LAEALHQARLLALLVIPPAITPGTDQLGM (SEQ ID NO:562), and/or DGFSLMTYDYSTAHQPGPNA-PLSWVRACVQVLDPKXKWRTKSSWGST (SEQ ID NO:563). An additional embodiment is the polynucleotides encoding these polypeptides. The gene encoding the disclosed cDNA is thought to reside on chromosome 11. Accordingly, polynucleotides related to this invention are useful as a marker in linkage analysis for chromosome 11. When tested against Jurkat cell lines, supernatants removed from cells containing this gene activated the NF-kB transcription factor. Thus, it is likely that this gene activates Jurkat cells by activating a transcriptional factor found within these cells. Nuclear factor kB is a transcription factor activated by a wide variety of agents, leading to cell activation, differentiation, or apoptosis. Reporter constructs utilizing the NF-kB promoter element are used to screen supernatants for such activity.

This gene is expressed primarily in human T-cells, and to a lesser extent, in human colon carcinoma.

Therefore, polynucleotides and polypeptides of the invention are useful as reagents for differential identification of the tissue(s) or cell type(s) present in a biological sample and for diagnosis of diseases and conditions which include, but are not limited to, immune and gastrointestinal disorders and cancer. Similarly, polypeptides and antibodies directed to these polypeptides are useful in providing immunological probes for differential identification of the tissue(s) or cell type(s). For a number of disorders of the above tissues or cells, particularly of the immune and gastrointestinal systems, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 278 as residues: Leu-21 to Ala-30, Ser-38 to Asp-47, Pro-87 to Asp-94, Leu-197 to Thr-204, Pro-256 to Ser-262, Thr-277 to Arg-282, and/or Thr-293 to Trp-303.

The tissue distribution in human T-cells and human colon carcinoma indicates that the protein product of this gene is useful for the diagnosis and treatment of immune disorders and gastrointestinal diseases. Furthermore, this gene product may be involved in the regulation of cytokine production, antigen presentation, or other processes that may also suggest a usefulness in the treatment of cancer (e.g. by boosting immune responses). Since the gene is expressed in cells of lymphoid origin, the gene or protein, as well as, antibodies directed against the protein may show utility as a tumor marker and/or immunotherapy targets for the above listed tissues. Expression of this gene product in T cells also strongly indicates a role for this protein in immune function and immune surveillance.

Many polynucleotide sequences, such as EST sequences, are publicly available and accessible through sequence databases. Some of these sequences are related to SEQ ID NO:40 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1501 of SEQ ID NO:40, b is an integer of 15 to 1515, where both a and b correspond to the positions of nucleotide residues shown in SEQ ID NO:40, and where b is greater than or equal to a+14.

Features of Protein Encoded by Gene No: 31

The translation product of this gene shares sequence homology with Ribosomal protein L11 of *Caenorhabditis elegans*. (See Genbank Accession No. 156201.) One embodiment of the invention is a polypeptide comprising one or more of the following amino acid sequences: ERGVSINQFCKEFNERTKDIKEGIPLPT-KILVKPDRTFIKIGQPTVSYFL-KAAAGIEKGARQTGKEVAGLVTLKHVYE-IARIKAQDEAFALQDVPLSSVVRSIIGSARSLGIRW KDLSSEELAAFQKERAIFLAAQKEADLAAQEEAAKK (SEQ ID NO:564), ERGVSINQFCKEFNERTKDIKEGI-PLPTKILVKPDRTFEIKIGQPTVSYFL (SEQ ID NO:565), KAAAGIEKGARQTGKEVAGLVTLKHVYE-IARIKAQDEAFALQDVPLSSV (SEQ ID NO:566), and/or VRSIIGSARSLGIRVVKDLSSEE-LAAFQKERAIFLAAQKEADLAAQEEAAKK (SEQ ID NO:567). An additional embodiment is the polynucleotides encoding these polypeptides. The gene encoding the disclosed cDNA is thought to reside on chromosome 11. Accordingly, polynucleotides related to this invention are useful as a marker in linkage analysis for chromosome 11.

This gene is expressed in human embryo tissue, and to a lesser extent, in human epithelioid sarcoma.

Therefore, polynucleotides and polypeptides of the invention are useful as reagents for identification of the tissue(s) or cell type(s) present in a biological sample and for diagnosis of diseases and conditions which include, but are not limited to, development disorders and epithelial cell cancer. Similarly, polypeptides and antibodies directed to these polypeptides are useful in providing immunological probes for differential identification of the tissue(s) or cell type(s). For a number of disorders of the above tissues or cells, particularly of the embryonic and epithelial cell systems, expression of this gene at significantly higher or lower levels may be routinely detected in certain tissues or cell types (e.g.

embryonic, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 279 as residues: Lys-34 to Gly-40.

The tissue distribution in human embryo indicates that the protein product of this gene is useful for the diagnosis and treatment of developmental disorders and epithelial cancer. Furthermore, expression within embryonic tissue and other cellular sources marked by proliferating cells indicates that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:41 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 690 of SEQ ID NO:41, b is an integer of 15 to 704, where both a and b correspond to the positions of nucleotide residues shown in SEQ ID NO:41, and where b is greater than or equal to a+14.

Features of Protein Encoded by Gene No: 32

This gene is expressed primarily in resting T-cells.

Therefore, polynucleotides and polypeptides of the invention are useful as reagents for differential identification of the tissue(s) or cell type(s) present in a biological sample and for diagnosis of diseases and conditions which include, but are not limited to, inflammatory and general immune disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in T-cells indicates that the protein product of this gene is useful for the diagnosis and treatment of disorders of the immune system. Furthermore, this gene product may be involved in the regulation of cytokine production, antigen presentation, or other processes that may also suggest a usefulness in the treatment of cancer (e.g. by boosting immune responses). Since the gene is expressed in cells of lymphoid origin, the gene or protein, as well as, antibodies directed against the protein may show utility as a tumor marker and/or immunotherapy targets for the above listed tissues. Expression of this gene product in T cells also strongly indicates a role for this protein in immune function and immune surveillance.

Many polynucleotide sequences, such as EST sequences, are publicly available and accessible through sequence databases. Some of these sequences are related to SEQ ID NO:42 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1080 of SEQ ID NO:42, b is an integer of 15 to 1094, where both a and b correspond to the positions of nucleotide residues shown in SEQ ID NO:42, and where b is greater than or equal to a+14.

Features of Protein Encoded by Gene No: 33

This gene is believed to reside on chromosome 1. Accordingly, polynucleotides derived from this gene are useful in linkage analysis as chromosome 1 markers.

This gene is expressed primarily in prostate, and to a lesser extent in soares adult brain, human umbilical vein endothelial cells, and amniotic cells.

Therefore, polynucleotides and polypeptides of the invention are useful as reagents for differential identification of the tissue(s) or cell type(s) present in a biological sample and for diagnosis of diseases and conditions which include, but are not limited to, prostate-related disorders. Similarly, polypeptides and antibodies directed to these polypeptides are useful in providing immunological probes for differential identification of the tissue(s) or cell type(s). For a number of disorders of the above tissues or cells, particularly of the urinary system and nervous system expression of this gene at significantly higher or lower levels may be routinely detected in certain tissues or cell types (e.g. prostate, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in prostate indicates that the protein products of this gene are useful for the diagnosis and treatment of disorders of the urinary and nervous systems. Furthermore, the tissue distribution indicates that the protein product of this gene is useful for the detection/treatment of neurodegenerative disease states and behavioural disorders such as Alzheimers Disease, Parkinsons Disease, Huntingtons Disease, Tourette Syndrome, schizophrenia, mania, dementia, paranoia, obsessive compulsive disorder, panic disorder, learning disabilities, ALS, psychoses, autism, and altered bahaviors, including disorders in feeding, sleep patterns, balance, and perception. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:43 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1807 of SEQ ID NO:43, b is an integer of 15 to 1821, where both a and b correspond to the positions of nucleotide residues shown in SEQ ID NO:43, and where b is greater than or equal to a+14.

Features of Protein Encoded by Gene No: 34

This gene shares sequence homology with R05G6.4 gene product. (See Genbank Accession No. gi|1326338.) This gene also shares sequence homology with the cyclophilin-like protein CyP-60. (See Genbank Accession No. 1199598, see also Biochem. J. 314 (1), 313–319 (1996).) One embodiment of the invention is a polypeptide comprising one or more of the following amino acid sequences: AVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPSRTVTCPMSGKPLRMSDLTPVHFTPLDSSVDRVGLITRSERYVCAVTRDSLSNATPCAVLRPSGAVVTLECVEKLIRKDMVDPVTGDKLTDRDIIVLQRGGT (SEQ ID NO:568), YLYEREAILEYILHQKKEIARQMKAYEKQRGTRREEQKELQRAASQDHVRGFLE (SEQ ID NO:569), FTAKALSGTSPDDVQPGPSVGPPSKDKDKVLPSFWIPSLTPEAKATKLEKPSRTVTCPMSGKPL (SEQ ID NO:570), VHFTPLDSSVDRVGLITRSERYVCAVTRDSLSNATPCAVLRPSGAVVTLECVEKLI (SEQ ID NO:571), and/or MSDLTPVHFTLDSSVDRVGLITRSERYVCAVTRDSLSNATPCAVLRPSGAVVTLECVEKLIRKDM (SEQ ID NO:572). An additional embodiment is the polynucleotides encoding these polypeptides.

This gene is expressed primarily in human testis, and to a lesser extent in activated T-cells.

Therefore, polynucleotides and polypeptides of the invention are useful as reagents for differential identification of the tissue(s) or cell type(s) present in a biological sample and for diagnosis of diseases and conditions which include, but are not limited to, male reproductive disorders and in particular testicular cancer. Similarly, polypeptides and antibodies directed to these polypeptides are useful in providing immunological probes for differential identification of the tissue(s) or cell type(s). For a number of disorders of the above tissues or cells, particularly of the reproductive and immune systems, expression of this gene at significantly higher or lower levels may be routinely detected in certain tissues or cell types (e.g. testes, immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in human testis indicates that the protein product of this gene is useful for the diagnosis and treatment of disorders of the male reproductive system, and in particular of testicular cancer. Furthermore, this gene is useful for the treatment and diagnosis of conditions concerning proper testicular function (e.g. endocrine function, sperm maturation), as well as cancer. Therefore, this gene product is useful in the treatment of male infertility and/or impotence. This gene product is also useful in assays designed to identify binding agents as such agents (antagonists) are useful as male contraceptive agents. Similarly, the protein is believed to by useful in the treatment and/or diagnosis of testicular cancer. The testes are also a site of active gene expression of transcripts that may be expressed, particularly at low levels, in other tissues of the body. Therefore, this gene product may be expressed in other specific tissues or organs where it may play related functional roles in other processes, such as hematopoiesis, inflammation, bone formation, and kidney function, to name a few possible target indications. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:44 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1010 of SEQ ID NO:44, b is an integer of 15 to 1024, where both a and b correspond to the positions of nucleotide residues shown in SEQ ID NO:44, and where b is greater than or equal to a+14.

Features of Protein Encoded by Gene No: 35

The translation product of this gene shares sequence homology with Lpe5p of *Saccharomyces cerevisiae,* which is thought to be important in the metabolism of phospholipids. The gene encoding the disclosed cDNA is thought to reside on chromosome 8. Accordingly, polynucleotides related to this invention are useful as a marker in linkage analysis for chromosome 8.

This gene is expressed primarily in liver and brain.

Therefore, polynucleotides and polypeptides of the invention are useful as reagents for differential identification of the tissue(s) or cell type(s) present in a biological sample and for diagnosis of diseases and conditions which include, but are not limited to, metabolic disorders. Similarly, polypeptides and antibodies directed to these polypeptides are useful in providing immunological probes for differential identification of the tissue(s) or cell type(s). For a number of disorders of the above tissues or cells, particularly of the metabolic and nervous systems expression of this gene at significantly higher or lower levels may be routinely detected in certain tissues or cell types (e.g. liver, brain, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 283 as residues: Pro-14 to Leu-20, Lys-28 to Asn-38, Arg-109 to Arg-114, Lys-119 to Asn-124, Glu-152 to Leu-157, or Pro-172 to Val-180.

The tissue distribution in liver and brain, combined with the homology to Lpe5p of *Saccharomyces cerevisiae* indicates that the protein product of this gene is useful for the diagnosis and treatment of metabolic and nervous disorders. Additionally, the tissue distribution indicates that the protein product of this gene is useful for the detection and treatment of liver disorders and cancers (e.g. hepatoblastoma, jaundice, hepatitis, liver metabolic diseases and conditions that are attributable to the differentiation of hepatocyte progenitor cells). Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:45 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 969 of SEQ ID NO:45, b is an integer of 15 to 983, where both a and b correspond to the positions of nucleotide residues shown in SEQ ID NO:45, and where b is greater than or equal to a+14.

Features of Protein Encoded by Gene No: 36

This gene shares sequence homology with the nuclear ribonucleoprotein U (HNRNP U), encoded by *C. elegans* (See Genbank Accesion gi|1703576.) One embodiment of the invention is a polypeptide comprising one or more of the following amino acid sequences: MDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWD RDKvVREGPRSRSRSRXRRRKERAKSKEKKSEKKEK AQEEPPAKLLDDLFRKTKAAPCIYWLPLTDSQIVQK EAERAERAKEREKRRKEQEEEEQKEREKEAERERNRQLEREKRREHSRERDRERERERERDRGDRDRDRERDRERGRERDRRDTKRHSRSRSRSTPVRDRGGR (SEQ ID NO:573), ENDVPEPPMPIADQVSNDDRPEGSVEDEEKKESSLPKSFKRKISVVSA (SEQ ID NO:574), VDLHADDSRISEDETERNGDDGTHDKGLKICRTVTQV (SEQ ID NO:575), PQVSVEVALPPPAEHBEVKKVTLGDTLTRRSISQQKSGVSITIDDPVRTAQVPSPP (SEQ ID NO:576), LKELLGRTGTLVEEAFWIDKIKSHCFVTYSTVEEAVATRTALHGVKWPQSNPKFL (SEQ ID NO:577), VDRPSETKTEEQGIPRPLHPPPPPPVQPPQHPRAEQREQERAVREQWAERERE (SEQ ID NO:578), EWDRDKVREGPRSRSRSRXRRRKERAKSKEKKSEKKEKAQEEPPAKLLDDLFRKTKAAP (SEQ ID NO:579), LDVPLASRSPEFPLPLMTQSELPRCPPHPGAR (SEQ ID NO:581), LATLSISPIWSVLSL (SEQ ID NO:582), and PLTDSQIVQKEAERAERAKEREKRRKEQEEEEQKEREKEAERERNRQLEREKRREHSRERDRER (SEQ ID NO:580). An additional embodiment is the polynucleotides encoding these polypeptides. The gene encoding the disclosed cDNA is thought to reside on chromosome 14. Accordingly, polynucleotides related to this invention are useful as a marker in linkage analysis for chromosome 14.

This gene is expressed primarily in epididymus, and to a lesser extent in testes.

Therefore, polynucleotides and polypeptides of the invention are useful as reagents for differential identification of the tissue(s) or cell type(s) present in a biological sample and for diagnosis of diseases and conditions which include, but are not limited to, diseases of the male reproductive system. Similarly, polypeptides and antibodies directed to these polypeptides are useful in providing immunological probes for differential identification of the tissue(s) or cell type(s). For a number of disorders of the above tissues or cells, particularly of the male reproductive system, expression of this gene at significantly higher or lower levels may be routinely detected in certain tissues or cell types (e.g. epididymus, testes, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in epididymus and testes indicates that the protein product of this gene is useful for the diagnosis and treatment of male reproductive disorders. Furthermore, the protein product of this gene is useful for the treatment and diagnosis of conditions concerning proper reproductive and testicular function (e.g. endocrine function, sperm maturation), as well as cancer. Therefore, this gene product is useful in the treatment of male infertility and/or impotence. This gene product is also useful in assays designed to identify binding agents as such agents (antagonists) are useful as male contraceptive agents. Similarly, the protein is believed to by useful in the treatment and/or diagnosis of testicular cancer. The testes are also a site of active gene expression of transcripts that may be expressed, particularly at low levels, in other tissues of the body. Therefore, this gene product may be expressed in other specific tissues or organs where it may play related functional roles in other processes, such as hematopoiesis, inflammation, bone formation, and kidney function, to name a few possible target indications.

Features of Protein Encoded by Gene No: 37

This gene is expressed primarily in amygdala.

Therefore, polynucleotides and polypeptides of the invention are useful as reagents for differential identification of the tissue(s) or cell type(s) present in a biological sample and for diagnosis of diseases and conditions which include, but are not limited to, inflammatory diseases and reproductive disorders. Similarly, polypeptides and antibodies directed to these polypeptides are useful in providing immunological probes for differential identification of the tissue(s) or cell type(s). For a number of disorders of the above tissues or cells, particularly of the amygdala, expression of this gene at significantly higher or lower levels may be routinely detected in certain tissues or cell types (e.g. brain, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in amygdala indicates that the protein product of this gene is useful for the diagnosis and treatment of inflammatory diseases and neural disorders. The amygdala processes sensory information and relays this to other areas of the brain including the endocrine and autonomic domains of the hypothalamus and the brain stem. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:47 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 826 of SEQ ID NO:47, b is an integer of 15 to 840, where both a and b correspond to the positions of nucleotide residues shown in SEQ ID NO:47, and where b is greater than or equal to a+14.

Features of Protein Encoded by Gene No: 38

This gene shares sequence homology with human opsonin protein P35 fragment. (See Genbank Accession No. R94181.) The opsonin protein activates the phagocytosis of pathogenic microbes by phagocytic cells which indicates that the protein product of this gene may be useful in the treatment and/or prevention of a variety of immune conditions, particularly bacterial infections and antigen presentation. Preferred polypeptide fragments comprise the amino acid sequence: GCDSCPPHLPREAFAQDTQAE-GECSSRAERADMCPDAPPSQEVPEGPGAAP (SEQ ID NO:583), RGWLPSSCLSCALRVCPDSSSTQAMGML-LAFWLPGASWQEAARGQYSEDEDTDT-DEYKEAKASINPVTGRVEEKPPNPMEGM-TEEQKEHEA (SEQ ID NO:584), and/or TQAMGMLLAFWLPGASWQEAARGQYSE (SEQ ID NO:585). Also preferred are polynucleotide fragments encoding these polypeptide fragments.

This gene is expressed in immune-related tissues such as thymus, macrophage, and T cells.

Therefore, polynucleotides and polypeptides of the invention are useful as reagents for differential identification of the tissue(s) or cell type(s) present in a biological sample and for diagnosis of diseases and conditions which include, but are not limited to, immune disorders and infectious diseases. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 286 as residues: Lys-9 to Arg-14, or Met-38 to Asp-51.

The tissue distribution in immune tissues, particularly macrophages, combined with the homology to a conserved human opsonin protein indicates that the protein product of this gene is useful for diagnosis and treatment of immune disorders, as well as the treatment and/or diagnosis of infectious disease. Moreover, the gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:48 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2418 of SEQ ID NO:48, b is an integer of 15 to 2432, where both a and b correspond to the positions of nucleotide residues shown in SEQ ID NO:48, and where b is greater than or equal to a+14.

Features of Protein Encoded by Gene No: 39

The translation product of this gene shares sequence homology with alpha-2 type I collagen which is thought to be important in tissue repair. (See, e.g., Genbank Accession No. 211607.) Preferred polypeptide fragments comprise the amino acid sequence: PQLPSCGRPWPGTASVFQSH-TQGPREDPDPCRAQGSAGTHCPISLSPPRQ (SEQ ID NO:586), KTHPRALWSAGPSCALCPGGSGXTSPPQ-GAPRGIXWDRCPQIQVLEGQRVRF-PSQPQHPSHLAPRGGCGWRPDSR-PLLPTPSGLSSFFPLDAQCWPWRTVSWR (SEQ ID NO:587), AGAPGQQARLQYLLSFQGEGAPHEXGAT-GEGGDGAWEACXCXRCLLNWQAGG-WGLQLSLMWLHRGPLRPPGVRWTP-WAFLEACSWGPALSLLGSGHSLPGTHEQAAWSRGCG QHGQSPTQKCKSSKEPLAQAPPWDSPAAPPHQGFAD VLERPTLEPFGVLAPPVPSALVEAAXQVLLREPQGG FXGTAAHRSRCWKGSG (SEQ ID NO:588), MQLLFLL-PHPSPQLHASLPHSAALPCPRGESLT-TASPAGAAGRXDAVPRCRHQAGRG-WVPRGPCERGGGDRGKPRAVAWDXGSLRWAVWSAR AGQGRSSEPAPLASRRGYSTC-CLSRGKGLPMRXGRRGRGVMVPGKPACAXGAC (SEQ ID NO:589), QHPSHLAPRGGCGWRPDSR-PLLPTPSGLSSFFPL (SEQ ID NO:590), GVRWTP-WAFLEACSWGPALSLLGSGHSLPG (SEQ ID NO:591), WDSPAAPPHQGFADVLERPTLEPFGVLA (SEQ ID NO:592), and/or RSSEPAPLASRRGYSTC-CLSRGKGLPMR (SEQ ID NO:593). Also preferred are the polynucleotide sequences encoding these polypeptide sequences.

This gene is expressed primarily in the brain, and to a lesser extent, in the kidney and thymus.

Therefore, polynucleotides and polypeptides of the invention are useful as reagents for differential identification of the tissue(s) or cell type(s) present in a biological sample and for diagnosis of diseases and conditions which include, but are not limited to, brain, kidney, endocrine, hematopoietic, and immune disorders. Similarly, polypeptides and antibodies directed to these polypeptides are useful in providing immunological probes for differential identification of the tissue(s) or cell type(s). For a number of disorders of the above tissues or cells, particularly of the brain, kidney, and immune disorders, expression of this gene at significantly higher or lower levels may be routinely detected in certain tissues or cell types (e.g., neural, urogenital, renal, immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in brain and thymus, combined with the homology to an alpha-2 type I collagen protein indicates that the protein product of this gene is useful for the diagnosis and treatment of tissue repair, and brain, kidney, immune disorders. Moreover, this protein may also be important in the diagnosis or treatment of various autoimmune disorders such as rheumatoid arthritis, lupus, scleroderma, and dermatomyositis as well as dwarfism, spinal deformation, and specific joint abnormalities as well as chondrodysplasias ie. spondyloepiphyseal dysplasia congenita, familial osteoarthritis, Atelosteogenesis type II, metaphyseal chondrodysplasia type Schmid. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:49 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1728 of SEQ ID NO:49, b is an integer of 15 to 1742, where both a and b correspond to the positions of nucleotide residues shown in SEQ ID NO:49, and where b is greater than or equal to a+14.

Features of Protein Encoded by Gene No: 40

The translation product of this gene shares sequence homology with mini-collagen which is thought to be important in tissue repair and tumor metastasis, and potentially in cellular migration, attachment, and/or chemotaxis. (See Genbank Accession No. gnl|PID|d1006976.) Preferred polypeptide fragments comprise the amino acid sequence: PGFRGPSGSLGCSFFPRSLGRVLPPGC-QRPGAHADSSPPPTP (SEQ ID NO:594). Also preferred are polynucleotides encoding this polypeptide fragment. The gene encoding the disclosed cDNA is believed to reside on chromosome 16. Accordingly, polynucleotides related to this invention are useful as a marker in linkage analysis for chromosome 16.

This gene is expressed in ovarian cancer, and to a lesser extent, in dendritic cells and smooth muscle.

Therefore, polynucleotides and polypeptides of the invention are useful as reagents for differential identification of the tissue(s) or cell type(s) present in a biological sample and for diagnosis of diseases and conditions which include, but are not limited to, tumor metastasis, tissue repair, integumentary, reproductive, and/or immune disorders, particularly cancers. Similarly, polypeptides and antibodies directed to these polypeptides are useful in providing immunological probes for differential identification of the tissue(s) or cell type(s). For a number of disorders of the above tissues or cells, particularly of the tumor metastasis and tissue repair, expression of this gene at significantly higher or lower levels may be routinely detected in certain tissues or cell types (e.g., integumentary, immune, hematopoietic, reproductive, ovarian, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 288 as residues: Asn-2 to His-11.

The tissue distribution in dendritic cells, combined with the homology to the mini-collagen gene indicates that the protein product of this gene is useful for diagnosis and treatment of tumor metastasis and tissue repair. Alternatively, this protein may also be important in the diagnosis or treatment of various autoimmune disorders such as rheumatoid arthritis, lupus, scleroderma, and dermatomyositis as well as dwarfism, spinal deformation, and specific joint abnormalities as well as chondrodysplasias ie. spondyloepiphyseal dysplasia congenita, familial osteoarthritis, Atelosteogenesis type II, metaphyseal chondrodysplasia type Schmid. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:50 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1473 of SEQ ID NO:50, b is an integer of 15 to 1487, where both a and b correspond to the positions of nucleotide residues shown in SEQ ID NO:50, and where b is greater than or equal to a+14.

Features of Protein Encoded by Gene No: 41

This gene shares sequence homology with the HIV TAT protein. (See Genbank Accession No. 328416.) Preferred polypeptide fragments comprise the amino acid sequence: EDLKKPDPASLRAAS-CGEGKKRKACKNCTCGLAEELEKEK-SREQMSSQPKSACGNCYLGDAFRCAS-CPYLGMPAFKPGEKVLLS (SEQ ID NO:595); EDLKKPDPASLRAAS-CGEGKKRKACKNCTCGLAEELEKEK-SREQMSSQPKSACGNCYLGDAFRCAS-CPYLGMPAFKPGEKVLLSDSNLHD (SEQ ID NO:596); CGNCYLGDAFRCASCPYLGMPAFKPGEKVLLSDS (SEQ ID NO:597); SCGEGKKRKACKNCTCGLAEELEKE (SEQ ID NO:598), SQPKSACGNCYLGDAFRCASC (SEQ ID NO:599); CCCVSKDQGIMGPGFR (SEQ ID NO:601), HSVTELQTPALSLISAMLPP-SCLSELLVYSILCDTSQVAHNLLRAPED-SLTGCCDDIQCPSAPFHPQPHLTVALHL-CPVVIYVNLQVLNLLHILTYLEILHVL (SEQ ID NO:602), LLVYSILCDTSQVAHNLLRAPEDS (SEQ ID NO:603), LTVALHLCPVVYVNLQVLNLLHILT (SEQ ID NO:604), and/or REAGQNSERQYVSLSRDP (SEQ ID NO:600). Also preferred are polynucleotide fragments encoding these polypeptide fragments.

This gene is expressed primarily in the infant brain, and to a lesser extent, in the breast and testes.

Therefore, polynucleotides and polypeptides of the invention are useful as reagents for differential identification of the tissue(s) or cell type(s) present in a biological sample and for diagnosis of diseases and conditions which include, but are not limited to, neural, developmental, reproductive, brain, testes and breast disorders. Similarly, polypeptides and antibodies directed to these polypeptides are useful in providing immunological probes for differential identification of the tissue(s) or cell type(s). For a number of disorders of the above tissues or cells, particularly of the brain, testes and breast disorders, expression of this gene at significantly higher or lower levels may be routinely detected in certain tissues or cell types (e.g., neural, developmental, reproductive, testicular, breast, and cancerous and wounded tissues) or bodily fluids (e.g., seminal fluid, amniotic fluid, lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 289 as residues: Pro-7 to Val-15.

The tissue distribution in infant brain tissue indicates that the protein product of this gene is useful for diagnosis and treatment of neural and other related disorders. Similarly the protein product of this gene is useful for the detection/treatment of neurodegenerative disease states, behavioural disorders, or inflamatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Moreover, the gene or gene product may also play a role in the treatment and/or detection of developmental disorders associated with the developing embryo, sexually-linked disorders, or disorders of the cardiovascular or reproductive system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:51 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1314 of SEQ ID NO:51, b is an integer of 15 to 1328, where both a and b correspond to the positions of nucleotide residues shown in SEQ ID NO:51, and where b is greater than or equal to a+14.

Features of Protein Encoded by Gene No: 42

In specific embodiments, polypeptides of the invention comprise the following amino acid sequence: FFNALYVFRKPQAIFDSEKENKRKNPTKYNNPLRYIYFKVKLIFQFIPLANYKIK (SEQ ID NO:605). Polynucleotides encoding these polypeptides are also encompassed by the invention. The gene encoding the disclosed cDNA is believed to reside on chromosome 3. Accordingly, polynucleotides related to this invention are useful as a marker in linkage analysis for chromosome 3.

This gene is expressed primarily in the infant brain, human cerebellum, and to a lesser extent, in medulloblastoma.

Therefore, polynucleotides and polypeptides of the invention are useful as reagents for differential identification of the tissue(s) or cell type(s) present in a biological sample and for diagnosis of diseases and conditions which include, but are not limited to, brain related disorders, such as neurodegenerative conditions, medulloblastoma, and other cancers or proliferative conditions. Similarly, polypeptides and antibodies directed to these polypeptides are useful in providing immunological probes for differential identification of the tissue(s) or cell type(s). For a number of disorders of the above tissues or cells, particularly of the brain related disorders and brain cancers, including medulloblastoma, expression of this gene at significantly higher or lower levels may be routinely detected in certain tissues or cell types (e.g., neural, developmental, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 290 as residues: Thr-41 to Glu-47.

The tissue distribution in infant brain and medulloblastoma indicates that the protein product of this gene is useful for diagnosis and treatment of human brain related disorders, brain cancers, and medulloblastoma. Similarly, the protein product of this gene is useful for the detection/treatment of neurodegenerative disease states, behavioural disorders, or inflamatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Moreover, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:52 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1842 of SEQ ID NO:52, b is an integer of 15 to 1856, where both a and b correspond to the positions of nucleotide residues shown in SEQ ID NO:52, and where b is greater than or equal to a+14.

Features of Protein Encoded by Gene No: 43

The translation product of this gene shares sequence homology with a phosphotyrosine-independent ligand for the lck SH2 domain which is thought to be important in signal transduction related to phosphotyrosine-independent ligand for the lck SH2 domain, which may implicate this protein as playing an essential role in regulating key cellular processes such as cellular division, and potentially in male fertility. (See Genbank Accession No. gi|1184951.) Preferred polypeptide fragments comprise the amino acid sequence: ESSGQARTLADPGPGWPRQQGMCFGSLT-GLSTTPHGFLTVSAEAD-PRLIESLSQMLSMGFSDEGGWLTRLLQT-KNYDIGAALDTIQYSKH (SEQ ID NO:606), YSMVYIYHIFHHSLLDGQLGWFHI-FAIVSCAAPDIIFNSFAFSTYISKSCS-FYLQNVSCIHSSLSIFNLFQCPIISC-MEECNNWLTGLFLHFKIKRCDR (SEQ ID NO:607), LSPSPRCCPWASLMKAAGSPGSCRPRT-MTSERLWTPSSIQSIPRRCDHFCPPLL-RAPLLSHSCVKLA (SEQ ID NO:608), GWPRQQGM-CFGSLTGLSTTPHGFLTVSAEADPRL (SEQ ID NO:609), LGWFHIFAIVSCAAPDIIFNSFAFSTYISKSCS (SEQ ID NO:610), SLSIFNLFQCPIISCMEECNNWLTG (SEQ ID NO:611), and/or LMKAAGSPGSCRPRTMTSERLWTPS-SIQSI (SEQ ID NO:612). Also preferred are polynucleotide fragments encoding this polypeptide fragment. It is likely that this gene is a new member of a family of phosphotyrosine-independent ligands for the lck SH2 domains.

This gene is expressed primarily in the placenta, and to a lesser extent, in endothelial cells and neutrophils.

Therefore, polynucleotides and polypeptides of the invention are useful as reagents for differential identification of the tissue(s) or cell type(s) present in a biological sample and for diagnosis of diseases and conditions which include, but are not limited to, reproductive, cardiovascular, immune, and infectious diseases. Similarly, polypeptides and antibodies directed to these polypeptides are useful in providing immunological probes for differential identification of the tissue(s) or cell type(s). For a number of disorders of the above tissues or cells, particularly of the cardiovascular, reproductive, and immune system, and infectious diseases, expression of this gene at significantly higher or lower levels may be routinely detected in certain tissues or cell types (e.g., reproductive, cardiovascular, immune, hematopoietic, and cancerous and wounded tissues) or bodily fluids (e.g., lymph, amniotic fluid, seminal fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 291 as residues: Ile-93 to Arg-98.

The tissue distribution in placenta and endothelial tissues, combined with the homology to a phosphotyrosine-independent ligand for the lck SH2 domain indicates that the protein product of this gene is useful for diagnosis and treatment of cardiovascular, reproductive, and immune system diseases, as well as infectious diseases. Moreover, the polypeptide of this gene may be able to modulate T or B cell development and/or T or B cell activation (e.g. by modulation of Lck activity). It may also be capable of modulating degradation of cellular proteins (e.g. cell cycle regulatory proteins stimulating expression of cell cycle dependent kinase inhibitors and arresting cell cycle progression at specific boundaries to thereby modulate cell proliferation). p62 acts to boost B cell response and may be used to treat disorders where this is beneficial, e.g. infections by pathogenic microorganisms, e.g. bacteria, viruses and protozoans. p62 can be used to expand T cell populations for treating infectious diseases or cancer, e.g. the resulting cells may be transduced to render them resistant to HIV infection. Inhibitors of p62 can be used to reduce B or T cell responses and may be used to treat a variety of autoimmune diseases, e.g. diabetes mellitus, arthritis, multiple sclerosis allergic reactions, Crohn's diseases etc. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:53 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1544 of SEQ ID NO:53, b is an integer of 15 to 1558, where both a and b correspond to the positions of nucleotide residues shown in SEQ ID NO:53, and where b is greater than or equal to a+14.

Features of Protein Encoded by Gene No: 44

In specific embodiments, polypeptides of the invention comprise the following amino acid sequence: SSSSPRRPRELLGSLKTPLVRPHSAPLD-LPGSFCXHTADPMGALHTRFWGRQTWI-HRKLRLHGTSRLASKXGIQFLRNPSKTH-TPRDAAFRDPGQTPDPQSLQAPSPSKCSAPNRATSV WSLKPRLLYK HRPSSDKTPPPGRQAPLLFFSAG (SEQ ID NO:613), and/or FLRNPSKTHTPRDAAFRDPGQTPD-PQSLQA (SEQ ID NO:614). Polynucleotides encoding these polypeptides are also encompassed by the invention.

This gene is expressed primarily in the fetal brain, cerebellum, and to a lesser extent, in the placenta.

Therefore, polynucleotides and polypeptides of the invention are useful as reagents for differential identification of the tissue(s) or cell type(s) present in a biological sample and for diagnosis of diseases and conditions which include, but are not limited to, neural, developmental, or reproductive disorders, particularly cancers. Similarly, polypeptides and antibodies directed to these polypeptides are useful in providing immunological probes for differential identification of the tissue(s) or cell type(s). For a number of disorders of the above tissues or cells, particularly of the neuronal cell related disorders, expression of this gene at significantly higher or lower levels may be routinely detected in certain tissues or cell types (e.g., neural, reproductive, vascular, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 292 as residues: Thr-20 to Gly-28.

The tissue distribution in fetal brain, combined with the homology to proline-rich protein genes indicates that the protein product of this gene is useful for diagnosis and treatment of neuronal cell related disorders. Similarly, the protein product of this gene is useful for the detection/treatment of neurodegenerative disease states, behavioural disorders, or inflamatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival.Moreover, the gene or gene product may also play a role in the treatment and/or detection of developmental disorders associated with the developing embryo, sexually-linked disorders, or disorders of the cardiovascular system. Moreover, expression within fetal tissue and other cellular sources marked by proliferating cells indicates that this protein may play a role in the regulation of cellular division, and may show utility in the diagnosis and treatment of cancer and other proliferative disorders. Similarly, developmental tissues rely on decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:54 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 934 of SEQ ID NO:54, b is an integer of 15 to 948, where both a and b correspond to the positions of nucleotide residues shown in SEQ ID NO:54, and where b is greater than or equal to a+14.

Features of Protein Encoded by Gene No: 45

The translation product of this gene shares sequence homology with precerebellin precerebellin of human, which is thought to be important in synaptic physiology. (See Genbank Accession No. gi|180251.) The cerebellum contains a hexadecapeptide, termed cerebellin, that is conserved in sequence from human to chicken. Three independent, overlapping cDNA genes have been isolated from a human cerebellum cDNA library that encode the cerebellin sequence. The longest gene codes for a protein of 193 amino acids that we term precerebellin. This protein has a significant similarity (31.3% identity, 52.2% similarity) to the globular (non-collagen-like) region of the B chain of human complement component C1q. The region of relatedness extends over approximately 145 amino acids located in the carboxyl terminus of both proteins. Unlike C1q B chain, no collagen-like motifs are present in the amino-terminal regions of precerebellin. The amino terminus of precerebellin contains three possible N-linked glycosylation sites. Although hydrophobic amino acids are clustered at the amino terminus, they do not conform to the classical signal-peptide motif, and no other obvious membrane-spanning domains are predicted from the cDNA sequence. The cDNA predicts that the cerebellin peptide is flanked by Val-Arg and Glu-Pro residues. Therefore, cerebellin is not liberated from precerebellin by the classical dibasic amino acid proteolytic-cleavage mechanism seen in many neuropeptide precursors. In Northern (RNA) blots, precerebellin transcripts, with four distinct sizes (1.8, 2.3, 2.7, and 3.0 kilobases), are abundant in cerebellum. These transcripts are present at either very low or undetectable levels in other brain areas and extraneural structures. A similar pattern of cerebellin precursor transcripts are seen in rat, mouse, and human cerebellum. Furthermore, a partial genomic fragment from mouse shows the same bands in Northern blots as the human cDNA gene. During rat development, precerebellin transcripts mirror the level of cerebellin peptide. Low levels of precerebellin mRNA are seen at birth. Levels increase modestly from postpartum day 1 to 8, then increase more dramatically between day 5 and 15, and eventually reach peak values between day 21 and 56. It has been observed that cerebellin-like immunoreactivity is associated with Purkinje cell postsynaptic structures. Thus, it is likely that this gene also have synaptic activity. Northern analysis showed a brain-specific 2.4 kb message. This is consistant with the current insert size we have, suggesting our gene is full-length and is brain-specific. Preferred polypeptide fragments comprise the amino acid sequence: QEGSEPVLLEGECLV-VCEPGRAAAGGPGGAALGEAPPGRVAFX-AVRSHHHEPAGETGNGTSGAIYFDQV-LVNEGGGFDRASGSFVAPVRGVYSFRFHVVKVYNRQ TVQVSLMLNTWPVISAFANDPDVTREAATSSVLLPL DPGDRVSLRLRRGXSTGW (SEQ ID NO:615), GET-GNGTSGAIYFDQVLVNEGGGFDRASGSFVAPV (SEQ ID NO:616), NDPDVTREAATSSVLLPLDPGDRVS (SEQ ID NO:617), FHVVKVYNRQT (SEQ ID NO:618), IYFDQVLVN (SEQ ID NO:619), ESRERSGNR-RGAEDRGTCGLQSPSA (SEQ ID NO:620), EMPQFYF-FLKLGCLAQVPMQRGGIGARGSXXPAX-AVXGAREGRRKLSGAGFLCLKDLGPSEREDEEARET (SEQ ID NO:621), MPQFYFFLKLGCLAQVPMQRGGI-GARG (SEQ ID NO:622), QATCSASGSPGQFG-GCTPSPHGTGSCRHPGQGLRRSQRPGQSHRPRSPGP GRSRWPHWCHCRFPLLAHGGGFGPQQM-PLAQGVPLPGLLPRAPLQQLGQAHRPPGTPPPAGRAL TPPGPTRPPGPEAPEPRAARDCVGDLVASVAWLPTWL RGSATHKCPGLLPLFCFRSSPWILTAGTLIVCPL (SEQ ID NO:623), GCTPSPHGTGSCRHPGQGLRRSQRP (SEQ ID NO:624), SRWPHWCHCRFPLLAHGGGFGPQQMP (SEQ ID NO:625), DCVGDLVASVAWLPTWLRGSATH-KCPGL (SEQ ID NO:626), DDRPRVQHQAHLDSLAV-VHLHHMEPEAVDTPDRGYEGARGPVKATAL VHQDLVEVDGPTGAIAGFPCWLMVVASDRXKCHSP RGCLSQGCSPGPPCSSSARLTDHQALPLQQDGL (SEQ ID NO:627), YEGARGPVKATALVHQDLVEVDGPTGA-IAGF (SEQ ID NO:628), MAPLVPLPVSPAGSWWWLR-TAXNATRPGGASPRAAPPGPPAAARPG-SQTTRHSPSSRTGSDPSWAHPAPRARSTRTKGSPGLCR GPGSQCGLAPNMAEGLCNPQVPRSSAPLLF PLLSLD-SHRRHPDSLPSLGSLNPLSIPVSQLCPASH SYSC-CHCSS (SEQ ID NO:629), SSRTGSDPSWAHPAPRAR-STRTKGSPGLC (SEQ ID NO:630), and/or RRHPDSLPSLGSLNPLSIPVSQLCPAS (SEQ ID NO:631). Also preferred are polynucleotide fragments encoding these polypeptide fragments.

This gene is expressed primarily in cerebellum and infant brain. By Northern analysis, a single transcript of 2.4 kb was observed in brain tissues.

Therefore, polynucleotides and polypeptides of the invention are useful as reagents for differential identification of the tissue(s) or cell type(s) present in a biological sample and for diagnosis of diseases and conditions which include, but are not limited to, neural and developmental disorders, particularly neuronal cell signal transduction, synaptic physiology, or proliferative conditions such as cancer. Similarly, polypeptides and antibodies directed to these polypeptides are useful in providing immunological probes for differential identification of the tissue(s) or cell type(s). For a number of disorders of the above tissues or cells, particularly of the neuronal cell signal transduction and synaptic physiology expression of this gene at significantly higher or lower levels may be routinely detected in certain tissues or cell types (e.g., neural, developmental, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in cerebellum and infant brain, combined with the homology to the conserved precerebellin gene or gene family indicates that the protein product of this gene is useful for diagnosis and treatment of neuronal cell related disorders. Furthermore, the protein product of this gene is useful for the detection/treatment of neurodegenerative disease states, behavioural disorders, or inflamatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Moreover, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:55 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 976 of SEQ ID NO:55, b is an integer of 15 to 990, where both a and b correspond to the positions of nucleotide residues shown in SEQ ID NO:55, and where b is greater than or equal to a+14.

Features of Protein Encoded by Gene No: 46

In specific embodiments, polypeptides of the invention comprise the following amino acid sequence: STHASGP-PAPERLCLPERGTAPWGRRANDAA (SEQ ID NO:632), VRRWWLRTMGAAAHCTPEQRRPRRPATILGMDTQNI LHTRLSLCSLSWVSLASSFXXLAXRRKAIVVQQKQS KISKKKKVEKXXLNDSVNENSDTVGQIVHYIMKNEA NADVLKAMVADNSLYDPESPVTPSTPG-SPPVSPGLCHQGGRQGSTSVAIICIR-WAVXSRGMCVIGVGTSGGTL (SEQ ID NO:633), and/or IMKNEANADVLKAMVADNSLYDPESPVTP (SEQ ID NO:634). Polynucleotides encoding these polypeptides are also encompassed by the invention.

This gene is expressed in fetal liver and spleen, and to a lesser extent in bone marrow, umbilical vein, and T cells.

Therefore, polynucleotides and polypeptides of the invention are useful as reagents for differential identification of the tissue(s) or cell type(s) present in a biological sample and for diagnosis of diseases and conditions which include, but are not limited to, disorders of the immune system, particularly hematopoiesis. Similarly, polypeptides and antibodies directed to these polypeptides are useful in providing immunological probes for differential identification of the tissue(s) or cell type(s). For a number of disorders of the above tissues or cells, particularly of the hematopoiesis and immune disorders, expression of this gene at significantly higher or lower levels may be routinely detected in certain tissues or cell types (e.g., immune, hematopoietic, developmental, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 294 as residues: Asp-30 to Glu-57.

The tissue distribution in fetal liver/spleen and bone marrow indicates that the protein product of this gene is useful for diagnosis and treatment of hematopoietic and immune disorders. Moreover, the protein product of this gene is useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:56 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1589 of SEQ ID NO:56, b is an integer of 15 to 1603, where both a and b correspond to the positions of nucleotide residues shown in SEQ ID NO:56, and where b is greater than or equal to a+14.

Features of Protein Encoded by Gene No: 47

The translation product of this gene shares sequence homology with a 12 kD nucleic acid binding protein of Feline calcivirus which is thought to be important in viral replication and may implicate this protein as playing an integral role in the development of host-viral inhibitors and/or novel vaccines. (See Genbank Accession No. 59264). In specific embodiments, polypeptides of the invention comprise the following amino acid sequence: HCHLWASGSCLACFFPGGLTRDAAQQHVTKSYSP-PYLSQTSHSCLVFQPVLWPEYTFWN-LFEAILQFQMNHSVLQQXGPRHVCRGAEEAAAGEGP GYSDRAAAARGAPSQWGRPAPKDT-LAQTLGQTGRAS PRLPAGLGTQAS (SEQ ID NO:635), PAPKDTLAQTLGQTGRASPRLPAGLGTQ (SEQ ID NO:636), TIACFSXKARDMYAEERKRQQLER-DQATVTEQLLREGLQASGDAQLRRTRLH-KLSARREERVQGFLQALELKRADWLARLGTASA (SEQ ID NO:637), and/or LRRTRLHKLSARREERVQG-FLQALELKR (SEQ ID NO:638). Polynucleotides encoding these polypeptides are also encompassed by the invention.

This gene is expressed primarily in human cardiomyopathy tissue, and to a lesser extent, in T helper cells, fetal brain and synovial sarcoma.

Therefore, polynucleotides and polypeptides of the invention are useful as reagents for differential identification of the tissue(s) or cell type(s) present in a biological sample and for diagnosis of diseases and conditions which include, but are not limited to, cardiovascular, immune, or developmental disorders, particularly cardiomyopathy which occur secondary to viral infections. Similarly, polypeptides and antibodies directed to these polypeptides are useful in providing immunological probes for differential identification of the tissue(s) or cell type(s). For a number of disorders of the above tissues or cells, particularly of the cardiovascular system, expression of this gene at significantly higher or lower levels may be routinely detected in certain tissues or cell types (e.g., cardiovascular, neural, developmental, skeletal, immune cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 295 as residues: Trp-20 to Cys-26.

The tissue distribution in cardiomyopathy tissue, combined with the homology to a viral 12 kD nucleic acid binding protein indicates that the protein product of this gene is useful for diagnosis and intervention of cardiomyopathy, including those caused by ischemic, hypertensive, congenital, valvular, or pericardial abnormalities. The gene expression pattern may be the consequence or the cause for these conditions. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:57 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1038 of SEQ ID NO:57, b is an integer of 15 to 1052, where both a and b correspond to the positions of nucleotide residues shown in SEQ ID NO:57, and where b is greater than or equal to a+14.

Features of Protein Encoded by Gene No: 48

The translation product of this gene shares sequence homology with tumor necrosis factor related gene product, which is thought to be important in tumor necrosis, bacterial and viral infection, immune diseases and immunoreactions. In specific embodiments, polypeptides of the invention comprise the following amino acid sequence: KMNSIPW-QIPKITPXLDANLVIVECKPLWFCIG-TIKQLKLWNQVFMGFKSMFFRIGKL-NYLFTIPYCYLFIDNILGIFYSILGAQGIKYNFYIQRIFT CLLNLNLKIHSNLA (SEQ ID NO:639), LWFCIG-TIKQLKLWNQVFMGFKSMFFR (SEQ ID NO:640), YSILGAQGIKYNFYIQRIFTCLLNLN (SEQ ID NO:641), and/or TFKLVR FLE (SEQ ID NO:642). Polynucleotides encoding these polypeptides are also encompassed by the invention. The gene encoding the disclosed cDNA is believed to reside on chromosome 10. Accordingly, polynucleotides related to this invention are useful as a marker in linkage analysis for chromosome 10.

This gene is expressed primarily in colon, and to a lesser extent, in ovarian and breast cancers.

Therefore, polynucleotides and polypeptides of the invention are useful as reagents for differential identification of the tissue(s) or cell type(s) present in a biological sample and for diagnosis of diseases and conditions which include, but are not limited to, gastrointestinal, reproductive, colon, ovarian, breast disorders, particularly cancers. Similarly, polypeptides and antibodies directed to these polypeptides are useful in providing immunological probes for differential identification of the tissue(s) or cell type(s). For a number of disorders of the above tissues or cells, particularly of the colon, ovary and breast, expression of this gene at significantly higher or lower levels may be routinely detected in certain tissues or cell types (e.g., gastrointestinal, reproductive, colon, ovarian, breast, and cancerous and wounded tissues) or bodily fluids (e.g., lymph, breast milk, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in colon tissue, combined with the homology to tumor necrosis factors indicates that the protein product of this gene is useful for the intervention of cancers of the colon, ovary and breast, particularly because TNF family members are known to be involved in the tumor development. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:58 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 800 of SEQ ID NO:58, b is an integer of 15 to 814, where both a and b correspond to the positions of nucleotide residues shown in SEQ ID NO:58, and where b is greater than or equal to a+14.

Features of Protein Encoded by Gene No: 49

The translation product of this gene shares sequence homology with mucins, such as epithelial mucin, which are thought to be important in extracellular matrix functions such as protection, lubrication and cell adhesion, which are important in a variety of functions, particularly immune chemotaxis and infiltration (See for example Genbank Accession No. R68002). Preferred polypeptide fragments comprise the following amino acid sequence: PRSRPALR-PGRQRPPSHSATSGVLRPRKKPDP (SEQ ID NO:643), RKSFAKPVLWTNAIQAGRGRVLCYTRPP-PASSSFSALVPDGNRMEGLRTYFLNAFD-PGTDYLYLFPFSFT VTFQHCLTVRWAFESLQVPQN-RPERWASHPLPTHXPAYLPDNQVXMSASG (SEQ ID NO:644), GNRMEGLRTYFLNAFDPGTDYLYLF (SEQ ID NO:645), and/or FQHCLTVRWAFESLQVPQNRPER-WASHPLP (SEQ ID NO:646). Also preferred are polynucleotide fragments encoding these polypeptide fragments. Moreover, this gene maps to chromosome 22q11.2-qter, and therefore, can be used as a marker in linkage analysis for chromosome 22.

This gene is expressed primarily in corpus colosum.

Therefore, polynucleotides and polypeptides of the invention are useful as reagents for differential identification of the tissue(s) or cell type(s) present in a biological sample and for diagnosis of diseases and conditions which include, but are not limited to, tumors, especially of the corpus colosum, as well as metastatic lesions, autoimmune conditions, and integumentary disorders. Similarly, polypeptides and antibodies directed to these polypeptides are useful in providing immunological probes for differential identification of the tissue(s) or cell type(s). For a number of disorders of the above tissues or cells, particularly of the corpus colosum and other solid tissues, expression of this gene at significantly higher or lower levels may be routinely detected in certain tissues or cell types (e.g., integumentary, autoimmune, neural, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in corpus colosum, combined with the homology to mucins indicates that the protein product of this gene is useful for serum tumor markers or immunotherapy targets because tumor cells have greatly elevated levels of mucin expression and shed the molecules into the epithelial tissues. Moreover, the protein product of this gene is useful for the treatment, diagnosis, and/or prevention of various skin disorders including congenital disorders (i.e. nevi, moles, freckles, Mongolian spots, hemangiomas, port-wine syndrome), integumentary tumors (i.e. keratoses, Bowen's disease, basal cell carcinoma, squamous cell carcinoma, malignant melanoma, Paget's disease, mycosis fungoides, and Kaposi's sarcoma), injuries and inflammation of the skin (i.e.wounds, rashes, prickly heat disorder, psoriasis, dermatitis), atherosclerosis, uticaria, eczema, photosensitivity, autoimmune disorders (i.e. lupus erythematosus, vitiligo, dermatomyositis, morphea, scleroderma, pemphigoid, and pemphigus), keloids, striae, erythema, petechiae, purpura, and xanthelasma. In addition, such disorders may predispose increased susceptibility to viral and bacterial infections of the skin (i.e. cold sores, warts, chickenpox, molluscum contagiosum, herpes zoster, boils, cellulitis, erysipelas, impetigo, tinea, althletes foot, and ringworm). Moreover, the protein product of this gene may also be useful for the treatment or diagnosis of various connective tissue disorders such as arthritis, trauma, tendonitis, chrondomalacia and inflammation, autoimmune disorders such as rheumatoid arthritis, lupus, scleroderma, and dermatomyositis as well as dwarfism, spinal deformation, and specific joint abnormalities as well as chondrodysplasias (ie. spondyloepiphyseal dysplasia congenita, familial osteoarthritis, Atelosteogenesis type II, metaphyseal chondrodysplasia type Schmid). Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:59 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1201 of SEQ ID NO:59, b is an integer of 15 to 1215, where both a and b correspond to the positions of nucleotide residues shown in SEQ ID NO:59, and where b is greater than or equal to a+14.

Features of Protein Encoded by Gene No: 50

This gene is expressed primarily in CD34 depleted buffy coat cord blood and primary dendritic cells.

Therefore, polynucleotides and polypeptides of the invention are useful as reagents for differential identification of the tissue(s) or cell type(s) present in a biological sample and for diagnosis of diseases and conditions which include, but are not limited to, hematopoietic disorders and immunological disorders, particularly those related to developmental or reproductive conditions. Similarly, polypeptides and antibodies directed to these polypeptides are useful in providing immunological probes for differential identification of the tissue(s) or cell type(s). For a number of disorders of the above tissues or cells, particularly of the hematopoietic and immune systems, expression of this gene at significantly higher or lower levels may be routinely detected in certain tissues or cell types (e.g., developmental, immune, hematopoietic, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in CD34 depleted buffy coat cord blood and primary dendritic cells indicates that the protein product of this gene is useful for the diagnosis and treatment of hematopoietic and immune disorders. Secreted or cell surface proteins in the above tissue distribution often are involved in cell activation (e.g. cytokines) or molecules involved in cell surface activation. Moreover, the protein product of this gene is useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:60 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 464 of SEQ ID NO:60, b is an integer of 15 to 478, where both a and b correspond to the positions of nucleotide residues shown in SEQ ID NO:60, and where b is greater than or equal to a+14.

Features of Protein Encoded by Gene No: 51

The translation product of this gene shares sequence homology with Interferon induced 1–8 gene encoded polypeptide, which is thought to be important in binding to retroviral rev responsive elements and may be beneficial in the development of novel inhibitors of host-viral interactions leading to effective viral vaccines. Preferred polypeptide fragment comprise the following amino acid sequences: MTLITPSXKLTFXKGNKSWSSRACSSTLVDP (SEQ ID NO:647), FLFLHAVDPWPSNG (SEQ ID NO:648), WSCQSGVFLVFTGCSVLCQMLSGAVVVWRRS-APEDSAVWQASINKPRGKGRHGIKGENTSV (SEQ ID NO:649), and/or LVFTGCSVLCQMLSGAWVWRRSA-PEDSAVWQASI (SEQ ID NO:650). Also preferred are polynucleotide fragments encoding these polypeptide fragments.

This gene is expressed primarily in CD34 positive cells and neutrophils.

Therefore, polynucleotides and polypeptides of the invention are useful as reagents for differential identification of the tissue(s) or cell type(s) present in a biological sample and for diagnosis of diseases and conditions which include, but are not limited to, viral infection, such as AIDS, and other immune or hematopoietic disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 299 as residues: Gln-51 to Trp-62.

The tissue distribution in neutrophils and CD34 positive cells, combined with the homology to interferon induced gene 1–8 indicates that the protein product of this gene is useful for the intervention of retroviral infection including HIV. The factor may be involved in viral stability or viral entry into the cells. Alternatively, the virus/factor complex may elicit the cellular immune reaction and could possibly play a beneficial role in the develpoment of effective inhibitors of host-viral interactions, such as exists for novel viral vaccines. Moreover, this gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:61 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 604 of SEQ ID NO:61, b is an integer of 15 to 618, where both a and b correspond to the positions of nucleotide residues shown in SEQ ID NO:61, and where b is greater than or equal to a+14.

Features of Protein Encoded by Gene No: 52

This gene shares sequence homology to immunoglobulin lambda chain (See Genbank Accession No. 2865484). Therefore it is likely that this gene has activity similar to an immunoglobulin lambda chain and may play a benefical role in the development of effective immunotherapy-based toxins. Preferred polypeptide fragments comprise the following amino acid sequence: GHPSPALSIAPSDG-SQLPCDEVPYGEAHVTRYCKKPLTNSHLETEAQSSSL (SEQ ID NO:65 1), NNKHYLSFCGSGFCPVYLGFT-GLASHQAVKVLVVAVIIPRQDRERI-CLQAQVGRIHLRGCWTGPPFLDGY-WSEAFYNTLSRGPLHRAPHHMATGFHQREQWKEQE KGDQGRHRSLLVASPQKRCYFCCILXVRSESLGPG VEFYXGVNGRR (SEQ ID NO:652), ERICLQAQV-GRIHLRGCWTGPPFLDGYWSEAF (SEQ ID NO:653), SDGSQLPCDEVPYGEAHVTRYCKKPL (SEQ ID NO:654), and/or HQREQWKEQEKGDQGRHR SLLVASPQK (SEQ ID NO:655). Also preferred are polynucleotide fragments encoding these polypeptide fragments.

This gene is expressed primarily in Hodgkin's lymphoma.

Therefore, polynucleotides and polypeptides of the invention are useful as reagents for differential identification of the tissue(s) or cell type(s) present in a biological sample and for diagnosis of diseases and conditions which include, but are not limited to, Hodgkin's lymphoma and other immune or hematopoietic disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 300 as residues: Pro-27 to Thr-32.

The tissue distribution in Hodgkin's lymphoma, combined with the sequence homology to immunoglobulin lambda chain protein indicates that the protein product of this gene is useful for the diagnosis of Hodgkin's lymphoma, since the elevated expression and secretion by the tumor mass may be indicative of tumors of this type. Additionally the gene product may be used as a target in the immunotherapy of the cancer. Because the gene is expressed in cells of lymphoid origin, the natural gene product may be involved in immune functions. Therefore it may be also used as an agent for immunological disorders including arthritis, asthma, immune deficiency diseases such as AIDS, and leukemia. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:62 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 737 of SEQ ID NO:62, b is an integer of 15 to 751, where both a and b correspond to the positions of nucleotide residues shown in SEQ ID NO:62, and where b is greater than or equal to a+14.

Features of Protein Encoded by Gene No: 53

This gene has extensive homology to cDNA for Homo sapiens mRNA for the ISLR gene(See Genbank Accession No. AB003184). This protein is considered to be a new member of the Ig superfamily and contains a leucine-rich repeat (LRR) with conserved flanking sequences and a C2-type immunoglobulin (Ig)-like domain. These domains are important for protein-protein interaction or cell adhesion, and therefore it is possible that the novel protein ISLR may also interact with other proteins or cells. The ISLR gene was mapped on human chromosome 15q23-q24 by fluorescence in situ hybridization (See Medline Article No. 97468140). Homology to the ISLR gene has been confirmed by another independent group as well (See Genbank Accession No. Hs.102171).

This gene is expressed in a number of tissues including human retina, heart, skeletal muscle, prostate, ovary, small intestine, thyroid, adrenal cortex, testis, stomach, spinal cord, fetal lung and fetal kidney tissues, colon, tonsil and stomach cancer, and to a lesser extent in endometrial stromal cells treated with estradiol, breast tissue, synovium, lymphoma, and number of other tumors.

Therefore, polynucleotides and polypeptides of the invention are useful as reagents for differential identification of the tissue(s) or cell type(s) present in a biological sample and for diagnosis of diseases and conditions which include, but are not limited to, tumors of colon, ovary, breast, and integumentary or immune origins. However, due to the wide range of expression in various tissues, protein may play a vital role in the development of cancer in other tissues as well, not just those mentioned above. Similarly, polypeptides and antibodies directed to these polypeptides are useful in providing immunological probes for differential identification of the tissue(s) or cell type(s). For a number of disorders of the above tissues or cells, particularly of the colon, ovary and breast, expression of this gene at significantly higher or lower levels may be routinely detected in certain tissues or cell types (e.g., immune, integumentary, reproductive, developmental, and cancerous and wounded tissues) or bodily fluids (e.g., lymph, amniotic fluid, breast milk, seminal fluid, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder. Additionally, this gene maps to chromosome 15q23-q24, and therefore, can be used as a marker in linkage analysis for chromosome 15.

The tissue distribution in tumors of colon, ovary, and breast origins indicates that the protein product of this gene is useful for the diagnosis and intervention of these tumors, in addition to other tumors where expression has been indicated. The secreted protein can also be used to determine biological activity, to raise antibodies, as tissue markers, to isolate cognate ligands or receptors, to identify agents that modulate their interactions and as nutritional supplements. It may also have a very wide range of biological acitivities. Typical of these are cytokine, cell proliferation/differentiation modulating activity or induction of other cytokines; immunostimulating/immunosuppressant activities (e.g. for treating human immunodeficiency virus infection, cancer, autoimmune diseases and allergy); regulation of hematopoiesis (e.g. for treating anaemia or as adjunct to chemotherapy); stimulation or growth of bone, cartilage, tendons, ligaments and/or nerves (e.g. for treating wounds); stimulation of follicle stimulating hormone (for control of fertility); chemotactic and chemokinetic activities (e.g. for treating infections, tumors); hemostatic or thrombolytic activity (e.g. for treating haemophilia, cardiac infarction, etc.); anti-inflammatory activity (e.g. for treating septic shock, Crohn's disease); as antimicrobials; for treating psoriasis or other hyperproliferative diseases; for regulation of metabolism, and behaviour. Also contemplated is the use of the corresponding nucleic acid in gene therapy procedures. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:63 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 766 of SEQ ID NO:63, b is an integer of 15 to 780, where both a and b correspond to the positions of nucleotide residues shown in SEQ ID NO:63, and where b is greater than or equal to a+14.

Features of Protein Encoded by Gene No: 54

Gene has homology to a multidrug resistence gene 1 (See Genbank Accession No. P06795). Preferred polynucleotide fragments comprise the following sequence: gcttcgtgtccaac-cctcttgcccttcgcctgtgtgcctggagccagtcccaccac gctcgcgtttcctc-ctgtagtgctcacaggtcccagcaccgatggcattcccttttgcc ctgagtctg-cagcgggtcccttttgtgcttccttcccctcaggtagcctctctccccct gggccactcccgggggtgaggggggttacccctttccagtgtttttttattcctgtggg gctcaccccaaagtattaaaagtagctttgtaa(SEQ ID NO:656), gct-tcgtgtccaaccctcttgcccttcgcctgtgtgcctggagccagtcccac cacgctcgcgtttcctcctgtagtgctcacaggtcccagcac cgatggcattc-cctttgccctgagtctgcagcgggtcccttttgtgc ttccttcccctcaggtagc-ctctctccccctgggccactcccgggggtgaggggggttacccccttccc agt-gttttttattcctgtggggctcaccccaaagtattaaaagtagctttgtaa (SEQ ID NO:657), gcttcgtgtccaaccctcttgcccttcgcctgtgtgcctgga gccagtcccaccacgctcgcgtttcctcctgtagtgctcacaggtcccagcac cgatggcattcccttttgccctgagtctgcagcgggtcccttttgtgcttccttcccc tcaggtagcctctctccccctgggccactcccgggggtgagggggt taccccttc-ccagtgttttttattcctgtggggctcaccccaaagtattaaaagtagctttgtaa (SEQ ID NO:658). Also preferred are polypeptides comprising one or more of the fragments encoded by these polynucleotide fragments. Moreover, In specific embodiments, polypeptides of the invention comprise the following amino acid sequence: FRINRLTIGXA-VAMTRGNQRELARQKNMKKQSDS-VKGKRRDDGLSAAARKQRDSEI (SEQ ID NO:659), AVAMTRGNQRELARQKNMKKQSDSVKGKR (SEQ ID NO:660), KSRATRLRESAEMTGFLLPPASRGTRR SCSRSRKRQTRRRRNPSSFVASCPTLLPFACVPGAS PTTLAFPPVVLTGPSTDGIPFALSLQRVPFVLPSPQ VASLPLGHSRG(SEQ ID NO:661), LRESAEMTGFLLP-PASRGTRRSCSRS (SEQ ID NO:662), and/or VVLTGP-STDGIPFALSLQRVPFVLPSPQVA (SEQ ID NO:663). Polynucleotides encoding these polypeptides are also encompassed by the invention.

This gene is expressed primarily in lung, esophagus, leukemia (Jurkat cells), breast cancers and to a lesser extent, in macrophages treated with GM-CSF fetal tissues.

Therefore, polynucleotides and polypeptides of the invention are useful as reagents for differential identification of the tissue(s) or cell type(s) present in a biological sample and for diagnosis of diseases and conditions which include, but are not limited to, immune, developmental, or pulmonary disorders, particularly cancers. Similarly, polypeptides and antibodies directed to these polypeptides are useful in providing immunological probes for differential identification of the tissue(s) or cell type(s). For a number of disorders of the above tissues or cells, particularly of the solid tumors, lung and leukemia, expression of this gene at significantly higher or lower levels may be routinely detected in certain tissues or cell types (e.g., immune, developmental, pulmonary, and cancerous and wounded tissues) or bodily fluids (e.g., lymph, pulmonary surfactant and sputum, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder. Furthermore, due to the high expression level in lung tissue and the proposed function of the multidrug resistance protein 1 gene as the efflux pump resposible for low-drug accumulation in multidrug-resistent cells, protein as well mutants thereof, may also be beneficial as a target for gene therapy, particularly for the chronic patient.

Preferred epitopes include those comprising a sequence shown in SEQ ID NO: 302 as residues: Met-1 to Lys-16.

The tissue distribution cancers and fetal tissues indicates that the protein product of this gene is useful for the detection of cells in active proliferation, such as cancers. The gene products may be used for cancer markers or immunotherapy target. Similarly, the secreted protein can also be used to determine biological activity, to raise antibodies, as tissue markers, to isolate cognate ligands or receptors, to identify agents that modulate their interactions and as nutritional supplements. It may also have a very wide range of biological acitivities. Typical of these are cytokine, cell proliferation/differentiation modulating activity or induction of other cytokines; immunostimulating/immunosuppressant activities (e.g. for treating human immunodeficiency virus infection, cancer, autoimmune diseases and allergy); regulation of hematopoiesis (e.g. for treating anaemia or as adjunct to chemotherapy); stimulation or growth of bone, cartilage, tendons, ligaments and/or nerves (e.g. for treating wounds); stimulation of follicle stimulating hormone (for control of fertility); chemotactic and chemokinetic activities (e.g. for treating infections, tumors); hemostatic or thrombolytic activity (e.g. for treating haemophilia, cardiac infarction, etc.); anti-inflammatory activity (e.g. for treating septic shock, Crohn's disease); as antimicrobials; for treating psoriasis or other hyperproliferative diseases; for regulation of metabolism, and behaviour. Also contemplated is the use of the corresponding nucleic acid in gene therapy procedures. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:64 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 574 of SEQ ID NO:64, b is an integer of 15 to 588, where both a and b correspond to the positions of nucleotide residues shown in SEQ ID NO:64, and where b is greater than or equal to a+14.

Features of Protein Encoded by Gene No: 55

In specific embodiments, polypeptides of the invention comprise the following amino acid sequence: ALLST-SHLLTQSYSFNKRSHSFAWKNAH-CILQSENNELQNSVYIYVCIYVHFICTFLCDI (SEQ ID NO:664), and/or KRSHSFAWKNAHCILQSENNELQNS-VYIYVCI (SEQ ID NO:665). Polynucleotides encoding these polypeptides are also encompassed by the invention. The gene encoding the disclosed cDNA is believed to reside on the X chromosome. Accordingly, polynucleotides related to this invention are useful as a marker in linkage analysis for the X chromosome.

This gene is expressed primarily in the brain, and to a lesser extent, in the developing embryo.

Therefore, polynucleotides and polypeptides of the invention are useful as reagents for differential identification of the tissue(s) or cell type(s) present in a biological sample and for diagnosis of diseases and conditions which include, but are not limited to, neurodegenerative disease states and developmental disorders. Similarly, polypeptides and antibodies directed to these polypeptides are useful in providing immunological probes for differential identification of the tissue(s) or cell type(s). For a number of disorders, including X-linked disorders, of the above tissues or cells, particularly of the neurological, developmental systems, and cardiovascular system, expression of this gene at significantly higher or lower levels may be routinely detected in certain tissues or cell types (e.g., neural, developmental, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neural tissue indicates that the protein product of this gene is useful for the detection/treatment of neurodegenerative disease states and behavioural disorders such as Alzheimers Disease, Parkinsons Disease, Huntingtons Disease, Klinefelter's, schizophrenia, mania, dementia, paranoia, obsessive compulsive disorder and panic disorder. In addition, the gene or gene product may also play a role in the treatment and/or detection of developmental disorders associated with the developing embryo, sexually- or X-linked disorders, or disorders of the cardiovascular system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:65 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 931 of SEQ ID NO:65, b is an integer of 15 to 945, where both a and b correspond to the positions of nucleotide residues shown in SEQ ID NO:65, and where b is greater than or equal to a+14.

Features of Protein Encoded by Gene No: 56

The translation product of this gene shares sequence homology with paxillin, which is thought to be important in mediating signal transduction from growth factor receptors to the cytoskeleton. Moreover, in normal hematopoietic cells and myeloid cell lines, tyrosine phosphorylation of paxillin has been shown to be rapidly and transiently induced by interleukin-3 and several other hematopoietic growth factors. The predicted structure of paxillin implicates this molecule in protein-protein interactions involved in signal transduction from growth factor receptors and the BCR/ABL oncogene fusion protein to the cytoskeleton. Preferred polynucleotide fragments comprise the following sequence: tggctcactgtcttacaatcactgctgtggaatcatgataccacttttagctctrtg catcttccttcagtgtatttttgttttcaagaggaagtagattaactg gacaactttgagtactgacatcattgataaataaactggcttgtggtttcaa (SEQ ID NO:666). Also preferred are polypeptide fragments encoded by these polynucleotide fragments. More preferably, polypeptide fragments comprise the amino acid sequence: LDELMAHLTFMQAKVAVRADAGKKHLPD-KQDHKASLDSMLGGLEQELQDLGIATVP-KGHCASCQKPIAGKVIHALGQSWHPEH-FVCTHCKEEIGSSPFFERSGLXYCPNDYHQLFSPRCA YCAAPILDKVLTAMNQTWHPEHFFCSHC-GEVFGAEGF HEKDKKPYCRKDFLAMFSPKCGGCN-RPVLENYLSAMD TVWHPECFVCGDCFTSFSTGS-FFELDGRPFCELHYHH RRGTLCHGCGQPITGRCISAMGYKFHPEHFVCAFCLT QLSKGIFREQNDKTYCQPCFNKLF (SEQ ID NO:667), KASLDSMLGGLEQELQDLGIATVPKGH-CASCQKPIAGKVIHAL (SEQ ID NO:668), CPNDY-HQLFSPRCAYCAAPILDKVLTAMNQTWH-PEHFFCSHCGEVFGAEG (SEQ ID NO:669), DKKPYCRKDFLAMFSPKCGGCNRPVLE-NYLSAMDTVWHPECFVCGDCFTSFSTGS-FFELDGRPFCEL (SEQ ID NO:670), CGQPITGRC ISAMGYKFHPEHFVCAFCLTQLSKGIFREQNDKT YCQ (SEQ ID NO:671), HKSLAGAXVYTTNIQELNVY-SEAQEPKESPPPSKTSAAAQLDELMAHL-TEMQAKVAVRADAGKKHLPDKQDH-KASLDSMLGGLEQELQDLGIATVPKGHCASCQKPIA GKVIHALGQSWHPEHFVCTHCKEEIGSSPFFERSGL XYCPNDYHQLFSPRCAYCAAPILDKVLTAMNQTWHP EHFFCSHCGEVFGAEGFHEKDKKPYCRKDFLAMFSP KCGGCNRPVLENYLSAMDTVWH-PECFVCGDCFTSFS TGSFFELDGRPFCELHYHHR-RGTLCHGCGQPITGRC ISAMGYKFHPEHFVCAF-CLTQLSKGWREQNDKTYCQ PCFNKLFPL (SEQ ID NO:672), NVYSEAQEPKESPPPSKTSAAA (SEQ ID NO:673), DSMLGGLEQELQDLGIATVPKGHCAS (SEQ ID NO:674), YLSAMDTVWHPECFVCGDCFTSFSTG (SEQ ID NO:675), RCISAMGYKFHPEHFVCAF-CLTQLSK (SEQ ID NO:676), PTRPVLFFSTCQSCSSR-PVRQEHLGCRTMEELDALLEELERST-LQDSDEYSNPAPLPLDQHSRKETNLDETSEILSIQDN TSPLPAXSCILPISRSSMSTVKPKSQRNHHHLLKRQQ LLSWMSSWLT (SEQ ID NO:677), PVRQEHLGCRT-MEELDALLEELERSTLQ (SEQ ID NO:678), SCILPISRSSMSTVKPKSQRN (SEQ ID NO:679), WHPE-HFVCTHC (SEQ ID NO:680), LFSPRC (SEQ ID NO:681), PILDKV (SEQ ID NO:682), TWHPEHFF (SEQ ID NO:683), EGFHEKD (SEQ ID NO:684), KFHPEHFV-CAFCL (SEQ ID NO:685), PITGRCI (SEQ ID NO:686), and/or HPEHFVC (SEQ ID NO:687). Polynucleotide fragements encoding these preferred polypeptide fragments are also contemplated. The gene encoding the disclosed cDNA is believed to reside on chromosome 11. Accordingly, polynucleotides related to this invention are useful as a marker in linkage analysis for chromosome 11.

This gene is expressed primarily in brain, and to a lesser extent in the developing embryo.

Therefore, polynucleotides and polypeptides of the invention are useful as reagents for differential identification of the tissue(s) or cell type(s) present in a biological sample and for diagnosis of diseases and conditions which include, but are not limited to, neurological disease states and developmental abnormalities. Similarly, polypeptides and antibodies directed to these polypeptides are useful in providing immunological probes for differential identification of the tissue(s) or cell type(s). For a number of disorders of the above tissues or cells, particularly of the immune and nervous systems, expression of this gene at significantly higher or lower levels may be routinely detected in certain tissues or cell types (e.g., neural, developmental, immune, hematopoieitic, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in brain, combined with the homology to the conserved paxillin gene, indicates that the protein product of this gene is useful for the treatment and or detection of disease states associated with abnormal signal transduction in brain and/or the developing embryo. This would include treatment or detection of neurodegenerative disease states and behavioural disorders such as Alzheimers Disease, Parkinsons Disease, Huntintons Disease, schizophrenia, mania, dementia, paranoia, obsessive compulsive disorder and panic disorder and also in the treatment and or detection of embryonic development defects. Moreover, expression within embryonic tissue and other cellular sources marked by proliferating cells indicates that this protein may play a role in the regulation of cellular division, and may show utility in the diagnosis and treatment of cancer and other proliferative disorders. Similarly, developmental tissues rely on decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:66 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1852 of SEQ ID NO:66, b is an integer of 15 to 1866, where both a and b correspond to the positions of nucleotide residues shown in SEQ ID NO:66, and where b is greater than or equal to a+14.

Features of Protein Encoded by Gene No: 57

In specific embodiments, polypeptides of the invention comprise the following amino acid sequence: RIYCSEDTF-SPXAESGVSWQSSVSQLYQDYE (SEQ ID NO:688). Polynucleotides encoding these polypeptides are also encompassed by the invention.

This gene is expressed primarily in fetal spleen, brain, and to a lesser extent, in six week old embryo.

Therefore, polynucleotides and polypeptides of the invention are useful as reagents for differential identification of the tissue(s) or cell type(s) present in a biological sample and for diagnosis of diseases and conditions which include, but are not limited to, immune disorders, neurological disorders, and developmental abnormalities. Similarly, polypeptides and antibodies directed to these polypeptides are useful in providing immunological probes for differential identification of the tissue(s) or cell type(s). For a number of disorders of the above tissues or cells, particularly of the immune and developmental systems, expression of this gene at significantly higher or lower levels may be routinely detected in certain tissues or cell types (e.g., immune, neural, developmental, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 305 as residues: Arg-28 to Gly-34.

The tissue distribution in fetal spleen indicates that the protein product of this gene is useful for the treatment/detection of immune disorders such as arthritis, asthma, immune deficiency diseases such as AIDS, and leukemia. In addition the expression of this gene in the early embryo, indicates a key role in embryo development, and hence the gene or gene product could be used in the treatment and or detection of embryonic developmental defects. This would include treatment or detection of neurodegenerative disease states and behavioural disorders such as Alzheimers Disease, Parkinsons Disease, Huntintons Disease, schizophrenia, mania, dementia, paranoia, obsessive compulsive disorder and panic disorder and also in the treatment and or detection of embryonic development defects. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:67 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1138 of SEQ ID NO:67, b is an integer of 15 to 1152, where both a and b correspond to the positions of nucleotide residues shown in SEQ ID NO:67, and where b is greater than or equal to a+14.

Features of Protein Encoded by Gene No: 58

The translation product of this gene shares sequence homology with the gene disrupted in the neurodegenerative disease dentatorubal-pallidoluysian atrophy. Moreover, the translation product of this gene also shares homology with the GRASP65 protein, a protein involved in the stacking of golgi cisternae (See Genbank Accession No. A-F015264). Preferred polypeptide fragments comprise the following: MGSSQSVEIPGGGTEGYHVL-RVQENSPGHRAGLEPFFDHIVSING-SRLNKDNDTLKDLLKXNVEKPVKM-LIYSSKTLELRETSVTPSNLWGGQGLLGVSIRFCSFD GANENVWHVLEVESNSPAALAGLRPHISDYIIGADTV MNESEDLFSLIETHEAKPLKLYVYNTDTDNCREVIIT PNSAWGGEGSLGCGIGYGYLEIRIPTRPFBEGKKISL PGQMAGTPITFPLKDGFTEVQLSSVNPPSLSPPGTTG IEQSLTGLSISSTPPAVSSVLSTGVPTVPLLPPQVNQ SLTSVPPMNPATTLPGLMPLPAGLPNLPNLNLNLPAP HIMPGVGLPELVNPGLPPLPSMPPRNLPGIAPLPLPS EFLPSFPLVPESSSAASSGELLSSLPPTSNAPSDPAT TTAKADAASSLTVDVTPPTAKAPTTVEDRVGDSTPVS EKPVSAAVDANASESP (SEQ ID NO:689), SVEIPGGGTEGYHVLRVQBNSPGHRAGLEPFFDFIVSI NGSRLNKDNDTLKDLLKXNVEKPVKM-LIYSSKTLELRE TSVTPSNLWGGQGLLGVSIRFCSFDGANENVWH (SEQ ID NO:690), ESNSPAALAGLRPHSDYII-GADTVMNESEDLFSLIETHEAKPLKLY-VYNTDTDNCREVIITPNSAWGGEGSLGCGIGYGYLH RIPTRPEEEGKKISLPGQMAGTPITPLKDGPTEVQL SSVNPPSLSPPGTTGIEQSLTGLSISS (SEQ ID NO:691), ESNSPAALAGLRPHSDYIIGADTVMNSEDLFSLIET HEAKPLKLYVYNTDTDNCREVIITPN- SAWGGEGSLGCGIGYGYLHRIPTRPEEE- GKKISLPGQMAGTPITPLKDG- FTEVQLSSVNPPSLSPPGTTGIEQSLTGLSISS (SEQ ID NO:692) RIPTRPFEEGKKISLPGQMAGTPIT- PLKDGFTEVQLSSVNPPSLSPPGT- TGIEQSLTGLSISSTPPAVSSVLST- GVPTVPLLPPQVNQSLTSVPPMNPATTLPGLMPLPA GLPNLPNLNLNLPAPHIMPGVGLPELVNPGLPPLPS MPPRN (SEQ ID NO:693), PGLPPLPSMPPR NLPGIA- PLPLPSEFLPSFPLVPESSSAASSGELLSSLPPT SNAPS- DPATTTAKADAASSLTVDVTPPTAKAPTVEDRVGD STPVSEKPVSAAVDAN(SEQ ID NO:694), AWGGEGSLGCGIGYGYLHRIPT (SEQ ID NO:695), SPAALAGLRP (SEQ ID NO:696), and/or WGGQGLLG (SEQ ID NO:697). The gene encoding the disclosed cDNA is believed to reside on chromosome 2. Accordingly, polynucleotides related to this invention are useful as a marker in linkage analysis for chromosome 2.

This gene is expressed primarily in prostate cancer, and to a lesser extent, in the pineal glands and in fetal lung.

Therefore, polynucleotides and polypeptides of the invention are useful as reagents for differential identification of the tissue(s) or cell type(s) present in a biological sample and for diagnosis of diseases and conditions which include, but are not limited to, neurological, endocrine, reproductive, pulmonary, developmental disorders. Similarly, polypeptides and antibodies directed to these polypeptides are useful in providing immunological probes for differential identification of the tissue(s) or cell type(s). For a number of disorders of the above tissues or cells, particularly of the nervous, pulmonary, and endocrine systems, expression of this gene at significantly higher or lower levels may be routinely detected in certain tissues or cell types (e.g., neurological, endocrine, reproductive, pulmonary, developmental, and cancerous and wounded tissues) or bodily fluids (e.g., lymph, amniotic fluid, pulmonary surfactant and sputum, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 306 as residues: Asn-9 to Leu-14.

The abundance of this gene in the pineal gland and its homology to a gene disrupted in the neurodegenerative disease state Dentatorubral-pallidoluysian atrophy indicates that this gene may be useful in the treatment and/or detection of other neurodegenerative disease states and behavioural disorders such as Alzheimers Disease, Parkinsons Disease, Huntingtons Disease, schizophrenia, mania, dementia, paranoia, obsessive compulsive disorder and panic disorder. Alternatively, the abundance of this gene in fetal lung would suggest that misregulation of the expression of this protein product in the adult could lead to lymphoma or sarcoma formation, particularly in the lung; that it may also be involved in predisposition to certain pulmonary defects such as pulmonary edema and embolism, bronchitis and cystic fibrosis; and thus the gene or the gene product encoded by the gene could be used in the detection and/or treatment of these pulmonary disorders. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:68 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2469 of SEQ ID NO:68, b is an integer of 15 to 2483, where both a and b correspond to the positions of nucleotide residues shown in SEQ ID NO:68, and where b is greater than or equal to a+14.

Features of Protein Encoded by Gene No: 59

In specific embodiments, polypeptides of the invention comprise the following amino acid sequence: RNGALLD-KNFFNANSHFPVKGERIRRR (SEQ ID NO:698). Polynucleotides encoding these polypeptides are also encompassed by the invention.

This gene is expressed primarily in the developing embryo.

Therefore, polynucleotides and polypeptides of the invention are useful as reagents for differential identification of the tissue(s) or cell type(s) present in a biological sample and for diagnosis of diseases and conditions which include, but are not limited to, developmental abnormalities. Similarly, polypeptides and antibodies directed to these polypeptides are useful in providing immunological probes for differential identification of the tissue(s) or cell type(s). For a number of disorders of the above tissues or cells, particularly of the developmental system, expression of this gene at significantly higher or lower levels may be routinely detected in certain tissues or cell types (e.g., developing, proliferating, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution of this gene primarily in the embryo indicates the gene plays a key role in embryo development, and that the gene or the protein encoded by the gene could be used in the treatment and or detection of developmental defects in the embryo or in infants. Similarly, the relatively specific expression of this gene product during embryogenesis indicates that it may be a key player in the proliferation, maintenance, and/or differentiation of various cell types during development. It may also act as a morphogen to control cell and tissue type specification. Because of potential roles in proliferation and differentiation, this gene product may have applications in the adult for tissue regeneration and the treatment of cancers. Expression within embryonic tissue and other cellular sources marked by proliferating cells indicates that this protein may play a role in the regulation of cellular division, and may show utility in the diagnosis and treatment of cancer and other proliferative disorders. Similarly, developmental tissues rely on decisions involving cell differentiation and/or apoptosis in pattern formation. Thus, this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:69 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 522 of SEQ ID NO:69, b is an integer of 15 to 536, where both a and b correspond to the positions of nucleotide residues shown in SEQ ID NO:69, and where b is greater than or equal to a+14.

Features of Protein Encoded by Gene No: 60

This gene displays homology to nestin, an intermediate filament protein, the expression of which correlates with the proliferation of central nervous system progenitor cells and is useful in the identification of brain tumors. In specific embodiments, polypeptides of the invention comprise the following amino acid sequence: RGSGFGWTSF-PRPLPTELTCPGFHRERAFPPDGRVRGVRGWGIRRG CRAVWGVGACGCSPGSSWRGSAHRASG-PADLPVACRXEGGADSPSLLPSPP (SEQ ID NO:699), AVWGVGACGCSPGSSWRGSAHRA (SEQ ID NO:700), YRPTMEKMKQVVTQTRWMRPDAKRANR-RHRRISGKIFAWNPLPKTRFSRLLKAVSENTKRPEP SRPPWMVSHSVEAS (SEQ ID NO:701), and/or FAWN-PLPKTRFSRLLKAVSENTKRPEP (SEQ ID NO:702). Polynucleotides encoding these polypeptides are also encompassed by the invention. The gene encoding the disclosed cDNA is believed to reside on chromosome 1. Accordingly, polynucleotides related to this invention are useful as a marker in linkage analysis for chromosome 1.

This gene is expressed primarily in kidney, and to a lesser extent, in brain.

Therefore, polynucleotides and polypeptides of the invention are useful as reagents for differential identification of the tissue(s) or cell type(s) present in a biological sample and for diagnosis of diseases and conditions which include, but are not limited to, renal disorders and neurodegenerative conditions. Similarly, polypeptides and antibodies directed to these polypeptides are useful in providing immunological probes for differential identification of the tissue(s) or cell type(s). For a number of disorders of the above tissues or cells, particularly of the excretory and nervous systems, expression of this gene at significantly higher or lower levels may be routinely detected in certain tissues or cell types (e.g., neural, urogenital, renal, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 308 was residues: Thr-130 to Asn-137.

The tissue distribution in brain and kidney, combined with the homology to the conserved nestin protein, indicates that the protein product of this gene is useful for the detection and/or treatment of neurodegenerative disease states and behavioural disorders such as Alzheimers Disease, Parkinsons Disease, Huntingtons Disease, schizophrenia, mania, dementia, paranoia, obsessive compulsive disorder and panic disorder. In addition, its abundance in kidney indicates that it is useful in the treatment and detection of acute renal failure and other disease states associated with the kidney, such as nephritus, renal tubular acidosis, proteinuria, pyuria, edema, pyelonephritis, hydronephritis, nephrotic syndrome, crush syndrome, glomerulonephritis, hematuria, renal colic and kidney stones, in addition to Wilms Tumor Disease, and congenital kidney abnormalities such as horseshoe kidney, polycystic kidney, and Falconi's syndrome. Protein, as well as, antibodies directed against the protein may show utility as a tumor marker and/or immunotherapy targets for the above listed tissues. .

Many polynucleotide sequences, such as EST sequences, are publicly available and accessible through sequence databases. Some of these sequences are related to SEQ ID NO:70 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 560 of SEQ ID NO:70, b is an integer of 15 to 574, where both a and b correspond to the positions of nucleotide residues shown in SEQ ID NO:70, and where b is greater than or equal to a+14.

Features of Protein Encoded by Gene No: 61

This gene shares homology with the latrophilin-related protein 1 precursor as well as the calcium-independent alpha-latrotoxin receptor. alpha-Latrotoxin, a black widow spider neurotoxin, can bind to high affinity receptors on the presynaptic plasma membrane and stimulate massive neurotransmitter release in the absence of Ca2+. Neurexins, previously isolated as alpha-latrotoxin receptors, require Ca2+ for their interaction with the toxin and, thus, may not participate in the Ca2+-independent alpha-latrotoxin activity. However, latrophilin binds alpha-Latrotoxin with high affinity in the presence of various divalent cations (Ca2+, Mg2+, Ba2+, and Sr2+) as well as in EDTA. This presumably membrane-bound protein is localized to and differentially distributed among neuronal tissues, with about four times more latrophilin expressed in the cerebral cortex than in the cerebellum; subcellular fractionation showed that the protein is highly enriched in synaptosomal plasma membranes. Preferred polypeptide fragments comprise the following amino acid sequence: IYKVFRHTAGLKPE-VSCFENIRSCARXXXXXXXXXXXXWIFGVLHVVHA SVVTAYLFTVSNAFQGMFWLFLCVLSRKIQEEYYR LFKNVPCC (SEQ ID NO:703), WIFGVLHVVHASV-VTAYLFTVSNAFQGMFPLFLCV-LSRKIQEEYYRLFKNVPCC (SEQ ID NO:704), IYKV-FRHTAGLKPEVSCFENIRSCAR (SEQ ID NO:705), IIYKVFRHTAGLKPEVSCFENIRSCAR-GALALLFLLGTTWIFGVLHVVHASV-VTAYLFFVSNAFQG (SEQ ID NO:706), and/or EVSCFE-NIRSCARGALALLFLLGTTWIFGVLH (SEQ ID NO:707). Also preferred are polynucleotide fragments encoding these polypeptide fragments. (See Genbank Accession No. 2213659) The translation product of this gene also shares sequence homology with CD 97, a seven transmembrane bound receptor. The gene encoding the disclosed cDNA is believed to reside on chromosome 1. Accordingly, polynucleotides related to this invention are useful as a marker in linkage analysis for chromosome 1.

This gene is expressed primarily in infant brain and in endothelial cells.

Therefore, polynucleotides and polypeptides of the invention are useful as reagents for differential identification of the tissue(s) or cell type(s) present in a biological sample and for diagnosis of diseases and conditions which include, but are not limited to, neurological, vascular, and hematopoeitic disorders. Similarly, polypeptides and antibodies directed to these polypeptides are useful in providing immunological probes for differential identification of the tissue(s) or cell type(s). For a number of disorders of the above tissues or cells, particularly of the neurological and hematopoeitic systems, expression of this gene at significantly higher or lower levels may be routinely detected in certain tissues or cell types (e.g., vascular, neural, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 309 as residues: Lys-13 to Leu-21.

The tissue distribution in infant brain genes suggest that the protein product may be useful in the detection and/or treatment of neurodegenerative disease states and behavioural disorders such as Alzheimers Disease, Parkinsons Disease, Huntingtons Disease, schizophrenia, mania, dementia, paranoia, obsessive compulsive disorder and panic disorder, while its expression in in hematopoietic cell types indicates that the gene could be important for the treatment or detection of immune or hematopoietic disorders including arthritis, asthma and immunodeficiency diseases. Moreover, the expression within endothelial tissue indicates that the protein product of this gene may show utility in the treatment and/or prevention of a variety of vascular disorders, which include, but are not limited to microvascular disease, atherosclerosis, stroke, embolism, and aneurysm. Furthermore, expression within infant tissue indicates that this protein may play a role in the regulation of cellular division, and may show utility in the diagnosis and treatment of cancer and other proliferative disorders. Similarly, developmental tissues rely on decisions involving cell differentiation and/or apoptosis in pattern formation. Thus, this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:71 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 918 of SEQ ID NO:7 1, b is an integer of 15 to 932, where both a and b correspond to the positions of nucleotide residues shown in SEQ ID NO:71, and where b is greater than or equal to a+14.

Features of Protein Encoded by Gene No: 62

In specific embodiments, polypeptides of the invention comprise the following amino acid sequence: TTILRTCTIVCFYYWFNGVMVLLFFLDRNLLTFNQASIMPFSNTDFLHCLSFKKKLMLLRYIFYVVLTGPTLSLKGDENQIKNLFT (SEQ ID NO:708), IVCFYYWFNGVMVLLFFLDRNLL (SEQ ID NO:709), and/or LLRYIFYVVLTGPTLSLKGDENQI (SEQ ID NO:710). Polynucleotides encoding these polypeptides are also encompassed by the invention. The gene encoding the disclosed cDNA is believed to reside on chromosome 4. Accordingly, polynucleotides related to this invention are useful as a marker in linkage analysis for chromosome 4.

This gene is expressed primarily in fetal liver and fetal spleen.

Therefore, polynucleotides and polypeptides of the invention are useful as reagents for differential identification of the tissue(s) or cell type(s) present in a biological sample and for diagnosis of diseases and conditions which include, but are not limited to, hematopoietic, immunological, developmental, and/or hepatic disorders. Similarly, polypeptides and antibodies directed to these polypeptides are useful in providing immunological probes for differential identification of the tissue(s) or cell type(s). For a number of disorders of the above tissues or cells, particularly of the immune and hematopoetic systems, expression of this gene at significantly higher or lower levels may be routinely detected in certain tissues or cell types (e.g., hematopoietic, immune, hepatic, developmental, and cancerous and wounded tissues) or bodily fluids (e.g., lymph, amniotic fluid, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 310 as residues: Ser-91 to Lys-98.

The tissue distribution of this gene in fetal liver and spleen indicates that the gene could be important for the treatment or detection of immune or hematopoietic disorders including arthritis, leukemia, and immunodeficiency diseases. Moreover, the protein product of this gene is useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Moreover, expression within fetal tissue indicates that this protein may play a role in the regulation of cellular division, and may show utility in the diagnosis and treatment of cancer and other proliferative disorders. Similarly, developmental tissues rely on decisions involving cell differentiation and/or aapoptosis in pattern formation. Thus, this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:72 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 982 of SEQ ID NO:72, b is an integer of 15 to 996, where both a and b correspond to the positions of nucleotide residues shown in SEQ ID NO:72, and where b is greater than or equal to a+14.

Features of Protein Encoded by Gene No: 63

This gene shares homology with human serum amyloid protein (See Genbank Accession No. W13671). Preferred polypeptide fragments comprise the following amino acid sequence: ALTRIPPGDWVINVTAVSFAGKTTARFF-HSSPPSLGDQARTDPGHQRRD (SEQ ID NO:71 1), SMLLLFPLQERPQQDSFIRLLLAWGTRLELTLDIKGGI (SEQ ID NO:712), TGLWADGFSSHIIPPLMSRVSSS-LVPQARRRRMKESCCGLSCKGN SSNIDYPVTGRN-SCERAPLCAFALHFQERTXITGXGEDPG-PFQSXGRVTASRXTLACSHVAMTPAGCXQALGTPSS YCVRKAPRA (SEQ ID NO:713), and/or QAR-RRRMKESCCGLSCKGNSSNIDYPVT (SEQ ID NO:714). Also preferred are polynucleotide fragments encoding these polypeptide fragments The gene encoding the disclosed cDNA is believed to reside on chromosome 9. Accordingly, polynucleotides related to this invention are useful as a marker in linkage analysis for chromosome 9.

This gene is expressed primarily in fetal liver and spleen.

Therefore, polynucleotides and polypeptides of the invention are useful as reagents for differential identification of the tissue(s) or cell type(s) present in a biological sample and for diagnosis of diseases and conditions which include, but are not limited to, hematopoietic, immune, and/or developmental disorders. Similarly, polypeptides and antibodies directed to these polypeptides are useful in providing immunological probes for differential identification of the tissue(s) or cell type(s). For a number of disorders of the above tissues or cells, particularly of the hematopoietic and immune systems, expression of this gene at significantly higher or lower levels may be routinely detected in certain tissues or cell types (e.g., hematopoietic, immune, developmental, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution of this gene in fetal liver-spleen indicates that the gene is important for the treatment or detection of immune or hematopoietic disorders including arthritis, leukemia, and immunodeficiency diseases. Moreover, the protein product of this gene is useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency, etc. In addition, this gene product may have commercial utility in the expansion of stem cells and committed progenitors of various blood lineages, and in the differentiation and/or proliferation of various cell types. Furthermore, expression within fetal tissue indicates that this protein may play a role in the regulation of cellular division, and may show utility in the diagnosis and treatment of cancer and other proliferative disorders. Similarly, developmental tissues rely on decisions involving cell differentiation and/or apoptosis in pattern formation. Thus, this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:73 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 771 of SEQ ID NO:73, b is an integer of 15 to 785, where both a and b correspond to the positions of nucleotide residues shown in SEQ ID NO:73, and where b is greater than or equal to a+14.

Features of Protein Encoded by Gene No: 64

In specific embodiments, polypeptides of the invention comprise the following amino acid sequence: LWRSS-GVER (SEQ ID NO:715). Polynucleotides encoding these polypeptides are also encompassed by the invention. The gene encoding the disclosed cDNA is believed to reside on chromosome 3. Accordingly, polynucleotides related to this invention are useful as a marker in linkage analysis for chromosome 3.

This gene is expressed specifically in the brain.

Therefore, polynucleotides and polypeptides of the invention are useful as reagents for differential identification of the tissue(s) or cell type(s) present in a biological sample and for diagnosis of diseases and conditions which include, but are not limited to, neural disorders, particularly neurodegenerative disease states. Similarly, polypeptides and antibodies directed to these polypeptides are useful in providing immunological probes for differential identification of the tissue(s) or cell type(s). For a number of disorders of the above tissues or cells, particularly of the neurological systems, expression of this gene at significantly higher or lower levels may be routinely detected in certain tissues or cell types (e.g., neural, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in brain indicates that the protein product of this gene is useful for the detection/treatment of neurodegenerative disease states, behavioural disorders, or inflamatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Moreover, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:74 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1055 of SEQ ID NO:74, b is an integer of 15 to 1069, where both a and b correspond to the positions of nucleotide residues shown in SEQ ID NO:74, and where b is greater than or equal to a+14.

Features of Protein Encoded by Gene No: 65

This gene shares homology with a yeast protein. Preferred polypeptide fragments comprise the following amino acid sequence: LQEVNITLPENSVWYERYKFDIPVFHL (SEQ ID NO:716). Also preferred are polynucleotide fragments encoding these polypeptide fragments. (See Genbank Accession No. 1332638)

This gene is expressed primarily in fetal tissue (fetus and fetal liver).

Therefore, polynucleotides and polypeptides of the invention are useful as reagents for differential identification of the tissue(s) or cell type(s) present in a biological sample and for diagnosis of diseases and conditions which include, but are not limited to, hepatic, developmental, immune, and/or hematopoietic disorders, including cancers (e.g. hepatoblastoma). Similarly, polypeptides and antibodies directed to these polypeptides are useful in providing immunological probes for differential identification of the tissue(s) or cell type(s). For a number of disorders of the above tissues or cells, particularly of the hepatic system, expression of this gene at significantly higher or lower levels may be routinely detected in certain tissues or cell types (e.g., hepatic, developmental, immune, hematopoietic, and cancerous and wounded tissues) or bodily fluids (e.g., lymph, amniotic fluid, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 313 as residues: Asn-72 to Glu-77.

The tissue distribution in fetal liver indicates that the protein product of this gene is useful for the detection and treatment of liver disorders and cancers (e.g. hepatoblastoma, jaundice, hepatitis, liver metabolic diseases and conditions that are attributable to the differentiation of hepatocyte progenitor cells). In addition the expression in fetus would suggest a useful role for the protein product in developmental abnormalities, fetal deficiencies, pre-natal disorders and various would-healing models and/or tissue trauma. Moreover, the protein product of this gene is useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NQ:75 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 817 of SEQ ID NO:75, b is an integer of 15 to 831, where both a and b correspond to the positions of nucleotide residues shown in SEQ ID NO:75, and where b is greater than or equal to a+14.

Features of Protein Encoded by Gene No: 66

This gene has homology with a B-cell surface antigen which may indicate that this gene plays a role in the immune response, including, but not limited to disorders and infections of the immune system. Preferred polynucleotide fragments comprise the following sequence: TAGCATGTAGC-CAGTCGAATAACNTATAAGGACAAAGTGGAGTCCA CGCGTGCGGCCGTCTAGACTAGTGGATCCCCCGGC TGCAGGATTCGGCACGAG (SEQ ID NO:718). Also preferred are polypeptides comprising polypeptide fragments encoded by these polynucleotide fragments (See Genbank Accession No.T94535). Additionally, this gene shares homology with an interferon-gamma receptor. Preferred polypeptide fragments also comprise the following amino acid sequence: MQGSGSQFRACLLCLCFSCPCSPGG-PRWNSRQGGRRFPKTCRAISQNLVFKYK-TFCPVRYMQPHRSSLCLHFTSYV-FILSTWGSLRTYSTDLKKKKKNSRGGPVPIRPKS (SEQ ID NO:717), MQGSGSQFRACLLCLCFSCPCSPG-GPRWNSRQGGRRFPKTCRAISQNLVFK (SEQ ID NO:719), PVRYMQPHRSSLCLHFTSYV-FILSTWGSLRTYSTDLKKKKKNSRGGPVPIRPKS (SEQ ID NO:720), GEEQRDCSLGWRGVGMRATHC-QAARMFVLFSLPKYAGL (SEQ ID NO:721), TSG-SPGCRIRHELPGEEQRDCSLGWRGVG-MRATHCQAAR (SEQ ID NO:722), EPPIAKQQECSCFFPFQNMQGSGSQFRA-CLLCLCFSCPCSPGGPRWNSRQGGRRFP-KTCRAISQNLVFKYKTFCPVRYM-QPHRSSLCLHFTSYVFILSTWGSLRTYSTDLKKKKKN SRGGPVPIRPKS (SEQ ID NO:723), and/or QFRA-CLLCLCFSCPCSPGGPRWNSRQGGRRF (SEQ ID NO:724). Also preferred are polynucleotide fragments encoding these polypeptide fragments This gene is expressed primarily in T-cells and gall bladder.

Therefore, polynucleotides and polypeptides of the invention are useful as reagents for differential identification of the tissue(s) or cell type(s) present in a biological sample and for diagnosis of diseases and conditions which include, but are not limited to, immunological disorders and conditions (immunodeficiencies, cancer, leukemia, hematopoeisis), in addition to metabolic, gastrointestinal, and/or digestive disorders. Similarly, polypeptides and antibodies directed to these polypeptides are useful in providing immunological probes for differential identification of the tissue(s) or cell type(s). For a number of disorders of the above tissues or cells, particularly of the immune and digestive systems, expression of this gene at significantly higher or lower levels may be routinely detected in certain tissues or cell types (e.g., immune, hematopoietic, metabolic, gastrointestinal, digestive, and cancerous and wounded tissues) or bodily fluids (e.g., lymph, serum, bile, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 314 as residues: Thr-41 to Gly-52.

The tissue distribution in T-cells indicates that the protein product of this gene is useful for the treatment and diagnosis of immune disorders including: leukemias, lymphomas, auto-immune disorders, immuno-supressive (transplantation) and immunodeficiencies (e.g. AIDS), inflammation and hematopoeitic disorders. Moreover, the expression of this gene in gall bladder would suggest a possible role for this gene product in digestive disorders, particularly of the pancreas or liver. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:76 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 576 of SEQ ID NO:76, b is an integer of 15 to 590, where both a and b correspond to the positions of nucleotide residues shown in SEQ ID NO:76, and where b is greater than or equal to a+14.

Features of Protein Encoded by Gene No: 67

In specific embodiments, polypeptides of the invention comprise the following amino acid sequence: NQFTSCIL-FCDGGHWRELLFQSI (SEQ ID NO:725), AMSSKLLN-LLALLQYSVHDHCHPRRLLKRGARATL-RHKGWGPSSLRGCESFQIVLIGWGPDLAVGFGRGKL LSRSLPVRHGGVSEFCLPHRDVVRLEKVKK (SEQ ID NO:726), and/or GPSSLRGCESFQIVLIGWGPDLAVGF-GRGKLLS (SEQ ID NO:727). Polynucleotides encoding these polypeptides are also encompassed by the invention. The gene encoding the disclosed cDNA is believed to reside on chromosome 11. Accordingly, polynucleotides related to this invention are useful as a marker in linkage analysis for chromosome 11.

This gene is expressed primarily in a variety of fetal and developmental tissues (e.g. fetal spleen, infant brain).

Therefore, polynucleotides and polypeptides of the invention are useful as reagents for differential identification of the tissue(s) or cell type(s) present in a biological sample and for diagnosis of diseases and conditions which include, but are not limited to, developmental, immune or neurological abnormalities. Similarly, polypeptides and antibodies directed to these polypeptides are useful in providing immunological probes for differential identification of the tissue(s) or cell type(s). For a number of disorders of the above tissues or cells, particularly of the developing immune and central nervous systems, expression of this gene at significantly higher or lower levels may be routinely detected in certain tissues or cell types (e.g., neural, immune, hemaopoietic, hepatic, developmental, and cancerous and wounded tissues) or bodily fluids (e.g., lymph, amniotic fluid, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 315 as residues: Ser-38 to Ser-43.

The tissue distribution in fetal tissues indicates that the protein product of this gene is useful for developmental abnormalities or fetal deficiencies. The detection in infant brain would suggest a role in neurological disorders (both developmental and neurodegenerative conditions of the brain and nervous system, behavioral disorders, depression, schizophrenia, Alzheimer's disease, Parkinson's disease, Huntington's disease, mania, dementia). In addition, the detection in spleen would similarly suggest a role in the detection and treatment of immunologically mediated disorders (e.g. immunodeficiency, inflammation, cancer, wound healing, tissue repair, hematopoeisis). Protein, as well as, antibodies directed against the protein m ay show utility as a tumor marker and/or immunotherapy targets for the above listed tissues.

Many polynucleotide sequences, such as EST sequences, are publicly available and accessible through sequence databases. Some of these sequences are related to SEQ ID NO:77 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1260 of SEQ ID NO:77, b is an integer of 15 to 1274, where both a and b correspond to the positions of nucleotide residues shown in SEQ ID NO:77, and where b is greater than or equal to a+14.

Features of Protein Encoded by Gene No: 68

In specific embodiments, polypeptides of the invention comprise the following amino acid sequence: TRKNIDFX-ETEKYYLFSFSNNVSFKNFWLKYN (SEQ ID NO:728). Polynucleotides encoding these polypeptides are also encompassed by the invention.

This gene is expressed primarily in spleen, T-cells, and fetal heart.

Therefore, polynucleotides and polypeptides of the invention are useful as reagents for differential identification of the tissue(s) or cell type(s) present in a biological sample and for diagnosis of diseases and conditions which include, but are not limited to, immunological or hematopoietic deficiencies or disorders, including AIDS and cardiovascular or developmental conditions. Similarly, polypeptides and antibodies direct ed to these polypeptides are useful in providing immunological probes for differential identification of the tissue(s) or cell type(s). For a number of disorders of t he above tissues or cells, particularly of the immune and cardiovascular systems, expression of this gene at significantly higher or lower levels may be routinely detected in certain tissues or cell types (e.g., immune, hematopoietic, cardiovascular, developmental, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in spleen and T-cells indicates that the protein product of this gene is useful for the diagnosis and treatment of immune disorders including: leukemias, lymphomas, autoimmune disorders, immunodeficiencies (e.g. AIDS), immuno-suppressive conditions (transplantation) and hematopoeitic disorders. Moreover, the expression in fetal heart indicates that the protein product of this gene is useful for the treatment and diagnosis of cadiovascular disorders (e.g. heart disease, restenosis, atherosclerosis, stoke, angina, thrombosis). Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:78 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1119 of SEQ ID NO:78, b is an integer of 15 to 1133, where both a and b correspond to the positions of nucleotide residues shown in SEQ ID NO:78, and where b is greater than or equal to a+14.

Features of Protein Encoded by Gene No: 69

This gene shares homology with a human collagen protein. Preferred polypeptide fragments comprise the following amino acid sequence: MPRKTSKCRQLLCSGASR-NADTAARQSTCSSHRPPGKIPSLGPRRXPGCXSVPSS RGEQSTGSPAAPRCGRRDAHRGLPG-GAAMTPGDTWAS FNPRAGHSKSQGEGQESSGAS-RQDRHPVSHWVERQRE AWGAPRSSSAGGVKVAAT-TEREPEFKIKTGKA (SEQ ID NO:729), CSGASRNADTAARQSTCSSHRP-PGKIPSLGPRRXPGCXSVPSSRGEQSTG-SPAAPRCGRRDAHRGLPGGAAMTPGDT-WASFNPRAGHS (SEQ ID NO:730), QGEGQESSGASRQDRHPVSHWVER-QREAWGAPRSSSAGGVKVAATTEREPEFKIKTGKA (SEQ ID NO:731), IRHEGKRMLNESRKPLSFASRLSS-LYFKLGF-PFCGRSNLYSTCTAAPGGSPGLPLPFYPVADG (SEQ ID NO:732), TRAESLFPLLHAFPVFILNSGSLSV-VAATFIPPALLLLGAPQASLCLSTQWLT-GCLSCLDAPLLSCPSPWLLLCPAL-GLKLAHVSPGVMAAPPGRPLCASRLPHLGAAGEPV LCSPRLLGTELQPGXLRGPRLGILPGGRWEEQVLC LAAVSAFLDAPEHRSCRHFEVFLGMCQIT (SEQ ID NO:733), PALGLKLAHVSPGVMAAPPGRPLCASRLP (SEQ ID NO:734), GGRWEEQVLCLAAVSAFLDAPEHR (SEQ ID NO:735), SWPMCPPESWLLLLGGLCVRHVF-HTWGQLASPCSVPLGCLAQSCSLGXSVD-PDWGFCQGGDGRSRCFAWRLCLHFWT-PQSTEVAGTLRSSSACARLHE (SEQ ID NO:736), and/or GDGRSRCFAWRLCLHFWTPQSTEVAGTLR (SEQ ID NO:737). Also preferred are polynucleotide fragments encoding these polypeptide fragments This gene is expressed primarily in fetal heart.

Therefore, polynucleotides and polypeptides of the invention are useful as reagents for differential identification of the tissue(s) or cell type(s) present in a biological sample and for diagnosis of diseases and conditions which include, but are not limited to, cardiovascular or developmental disorders, particularly vascular conditions. Similarly, polypeptides and antibodies directed to these polypeptides are useful in providing immunological probes for differential identification of the tissue(s) or cell type(s). For a number of disorders of the above tissues or cells, particularly of the cardiovascular system, expression of this gene at significantly higher or lower levels may be routinely detected in certain tissues or cell types (e.g., cardiovascular, developmental, skeletal, vascular, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 317 as residues: Pro-32 to Ser-39.

The tissue distribution in fetal heart indicates that the protein product of this gene is useful for the treatment and diagnosis of cadiovascular disorders (e.g. heart disease, restenosis, atherosclerosis, stroke, angina, thrombosis), in addition to vascular disorders, such as microvascular disease. Expression within fetal tissue indicates that this protein may play a role in the regulation of cellular division, and may show utility in the diagnosis and treatment of cancer and other proliferative disorders. Similarly, developmental tissues rely on decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:79 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 647 of SEQ ID NO:79, b is an integer of 15 to 661, where both a and b correspond to the positions of nucleotide residues shown in SEQ ID NO:79, and where b is greater than or equal to a+14.

Features of Protein Encoded by Gene No: 70

The translation product of this gene shares sequence homology with a chicken single-strand DNA-binding protein. The promoter region of the chicken alpha2(I) collagen gene contains a pyrimidine-rich element that is well conserved in different mammalian species. This sequence can also form an unusual DNA structure as shown by its sensitivity to SI nuclease in vitro and it lies in a region that is DNase I-hypersensitive only when this promoter is active. The high affinity of this protein for this conserved pyrimidine-rich region indicates that it might be involved in the transcriptional regulation of the alpha2(I) collagen gene. Preferred polypeptide fragments comprise the following amino acid sequence: MSPRYPGGPRPPLRIPNQALG-GVPGSQPLLPSGMDPT RQQGHPNMGGPMQRMTP-PRGMVPLGPQNYGGAMRPPL NALGGPGMPGMN-MGPGGGRPWPNPTNANSIPYSSASP GNYVGPPGGGGPPGTPIMPSPADSTNS-GDNMYTLMNA VPPGPNRPNFPMGPGSDGPMGGLG-GMESHHMNGSLGS GDMDSISKNSPNNMSLSNQPGT-PRDDGEMGGNFLNPF QSESYSPSMTMSV(SEQ ID NO:738), MSPRYPGGPRPPLRIPNQALGGVPGSQ-PLLPSGMDPTRQQGHPNMGGPMQRMTP-PRGMVPLGPQNYGGAMRPPLNALGGPG- MPGMNMPGGGRPWPNPTNANSIPYSSASPGNY (SEQ ID NO:739), LNALGGPGMPGMNMPGGGRPW-PNPTNANSIPYSSASPGNYVGPPGGGGP-PGTPIMPSPADSTNSGDNMYTLMNAVPPGPN (SEQ ID NO:740), GPMGGLGGMESHHMNGSLGSGDMD-SISKNSPNNMSLSNQPGTPRDDGEMGGN-FLNPFQSESYSPSMTMSV (SEQ ID NO:741), TCEHS-SEAKAFHDY (SEQ ID NO:742), and/or RRETCEHSSEAKAFIHDYPF (SEQ ID NO:743). Also preferred are polynucleotide fragments encoding these polypeptide fragments. (See Genbank Accession No. 1562534)

This gene is expressed primarily in placenta, and to a lesser extent, in fetal heart.

Therefore, polynucleotides and polypeptides of the invention are useful as reagents for differential identification of the tissue(s) or cell type(s) present in a biological sample and for diagnosis of diseases and conditions which include, but are not limited to, developmental abnormalities, fetal deficiencies, and particularly of the cardiovascular system and/or vascular conditions. Similarly, polypeptides and antibodies directed to these polypeptides are useful in providing immunological probes for differential identification of the tissue(s) or cell type(s). For a number of disorders of the above tissues or cells, particularly of the reproductive system, expression of this gene at significantly higher or lower levels may be routinely detected in certain tissues or cell types (e.g., developmental, vascular, cardiovascular, reproductive, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 318 as residues: Met-1 to Leu-13, Gly-33 to Gly-46, Pro-48 to Gly-57, Pro-63 to Gly-68, Pro-89 to Asn-102, Ser-108 to Asn-113, Pro-118 to Pro-124, Pro-132 to Asn-141, Pro-151 to Asn-157, Ile-191 to Met-199, Ser-202 to Gly-215, Phe-222 to Pro-229.

The tissue distribution in fetal heart and placenta indicates that the protein product of this gene is useful for the detection and treatment of developmental abnormalities or fetal deficiencies, ovarian and other endometrial cancers, reproductive disfunction, cardiovascular disorders, and prenatal disorders, in particular vascular disorders, which include, but are not limited to, stroke, angina, microvascular disease, atherosclerosis, embolism, and aneurysm. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:80 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1364 of SEQ ID NO:80, b is an integer of 15 to 1378, where both a and b correspond to the positions of nucleotide residues shown in SEQ ID NO:80, and where b is greater than or equal to a+14.

Features of Protein Encoded by Gene No: 71

In specific embodiments, polypeptides of the invention comprise the following amino acid sequence: TITLFQSAWCFFSKYCTDFT (SEQ ID NO:744), VRGCEDGGGGIWGGWWPGQQMAPP-WLSCPHRQFPHFHSGRQRRQS-DLLKEELPQPSGAAGRASGNKPYTPP-PASNSLTLRLLSFRFNAFNRSHPQPSLNYKDRQ (SEQ ID NO:745), PWLSCPHRQFPHFHSGRQRRQSDLL (SEQ ID NO:746), and/or RLLSFRFNAFNRSHPQPSLN (SEQ ID NO:747). Polynucleotides encoding these polypeptides are also encompassed by the invention. The gene encoding the disclosed cDNA is believed to reside on chromosome 7. Accordingly, polynucleotides related to this invention are useful as a marker in linkage analysis for chromosome 7.

This gene is expressed primarily in fetal liver, and to a lesser extent, in the breast and testes.

Therefore, polynucleotides and polypeptides of the invention are useful as reagents for differential identification of the tissue(s) or cell type(s) present in a biological sample and for diagnosis of diseases and conditions which include, but are not limited to, hepatic disorders (including hepatoblastomas), hematopoietic, immune, and/or reproductive disorders. Similarly, polypeptides and antibodies directed to these polypeptides are useful in providing immunological probes for differential identification of the tissue(s) or cell type(s). For a number of disorders of the above tissues or cells, particularly of the hepatic and reproductive systems, expression of this gene at significantly higher or lower levels may be routinely detected in certain tissues or cell types (e.g., hematopoietic, immune, hepatic, reproductive, developmental, and cancerous and wounded tissues) or bodily fluids (e.g., lymph, amniotic fluid, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in fetal liver indicates that the protein product of this gene is useful for the detection and treatment of liver disorders and cancers (e.g. hepatoblastoma, jaundice, hepatitis, liver metabolic diseases and conditions that are attributable to the differentiation of hepatocyte progenitor cells). The expression in testes and breast indicates that the protein product of this gene is useful for the detection and treatment of endocrine and reproductive disorders (e.g. sperm maturation, milk production, testicular and breast cancers). Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:81 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1426 of SEQ ID NO:81, b is an integer of 15 to 1440, where both a and b correspond to the positions of nucleotide residues shown in SEQ ID NO:81, and where b is greater than or equal to a+14.

Features of Protein Encoded by Gene No: 72

In specific embodiments, polypeptides of the invention comprise the following amino acid sequence: RDSSL- WAAALSFRQQCSSLASCLVSMYSRPGRQHRAKA GAGSQTEQCWGRKVDAVV (SEQ ID NO:748), CLVSMYSRPGRQHRAKAGAGSQTEQCW (SEQ ID NO:749), PEHGFSSCDFWEGAPSSGPKEGGRSP-PQLACVWGMNLSSPPCLALLTNRA-CLAVNWHRVTLFPGIQVCNQNTGEEKLQDPCPHLSS (SEQ ID NO:750), RSPPQLACVWGMNLSSPPCLALLT-NRACLA (SEQ ID NO:751), CERDSETSSIAMTCIKHK-PPKQKKRLSLLPGFRSALPRVCRCH-MITVQREAFRTHTGCSTSVHLPSRGGFLPDF (SEQ ID NO:752), and/or KKRLSLLPGFRSALPRVCRCH-MITVQRE (SEQ ID NO:753). Polynucleotides encoding these polypeptides are also encompassed by the invention. The gene encoding the disclosed cDNA is believed to reside on chromosome 1. Accordingly, polynucleotides related to this invention are useful as a marker in linkage analysis for chromosome 1.

This gene is expressed primarily in smooth muscle, and to a lesser extent, in brain.

Therefore, polynucleotides and polypeptides of the invention are useful as reagents for differential identification of the tissue(s) or cell type(s) present in a biological sample and for diagnosis of diseases and conditions which include, but are not limited to, cardiovascular and neurological disorders, particularly embolism, atherosclerosis, stroke, aneurysm, and miscovascular disease. Similarly, polypeptides and antibodies directed to these polypeptides are useful in providing immunological probes for differential identification of the tissue(s) or cell type(s). For a number of disorders of the above tissues or cells, particularly of the cardiovascular and central nervous systems, expression of this gene at significantly higher or lower levels may be routinely detected in certain tissues or cell types (e.g., neural, vascular, endothelial, smooth muscle, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in brain and smooth muscle indicates that the protein product of this gene is useful for the detection and treatment of restenosis, atherosclerosis, stroke, angina, thrombosis, wound healing and other conditions of heart disease. Moreover, the protein product of this gene is useful for the detection and treatment of developmental, degenerative and behavioral conditions of the brain and nervous system (e.g. schizophrenia, depression, Alzheimer's disease, Parkinson's disease, Huntington's disease, mania, dementia, paranoia, addictive behavior and sleep disorders). Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:82 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1367 of SEQ ID NO:82, b is an integer of 15 to 1381, where both a and b correspond to the positions of nucleotide residues shown in SEQ ID NO:82, and where b is greater than or equal to a+14.

Features of Protein Encoded by Gene No: 73

This gene shares homology with human stromalin-2, which is believed to play an integral role in modulating cellular function of hematopoietic cells and tissues, and may possibly serve as a tumor suppressor. Preferred polypeptide fragments comprise the following amino acid sequence: QAFVLLSDLLLIFSPQMIVGGRDFLR-PLVFFPEATLQSELASFLMDHVFIQPGDLGSGA (SEQ ID NO:754), ACSYLLCNPEFIFFSRADFAR-SQLVDLLTDRFQQELEELLQVG (SEQ ID NO:755), QKQLSSLRDRMVAFCELCQSCLSDVDTEIQEQVST (SEQ ID NO:756), QVILPALTLVYFSILWTLTHISKSDAS (SEQ ID NO:757), STHDLTRWELYEPCCQLLQKAVDT-GXVPHQV (SEQ ID NO:758), TSFLFPLQAFVLLSDLL-LIFSPQMIVGGRDFLRPLVFFPEAT-LQSELASFLMDHVFIQPGDLGSGA (SEQ ID NO:759), GWGACSYLLCNPEFTFFSRADFAR-SQLVDLLTDRFQQELEELLQV-GAGAGQWDTPNKGGRGCKTGDVD (SEQ ID NO:760), VWVLDGIMGTEESVSSFFPFK-PLCPQKQLSSLRDRMVAFCELCQSCLSD-VDTEIQEQVSTDSSGSNKASIPAPIPRRN (SEQ ID NO:761), NASLPSTSEWLSSSSPSRFYWCLWSWF-PLFFSSITFPFLPQSTHDLTRWELYEPC-CQLLQKAVDTGXVPHQVSGQARDGLGAG-GLXFKDLRSRWPLGVSSLSAWSGQSEEDQVGGGHLL HSSLRRWTLLPGSSWISWKPRIILRDSRRRRVN (SEQ ID NO:762), VLGEMLLIFFPSQSSFLDEDEVYN-LAATLKRLSAFYK (SEQ ID NO:763), PKPHFSN-PLLLQVILPALTLVYFSILWTLTHISKSDASPGECGS (SEQ ID NO:764), and/or HCQFLLG (SEQ ID NO:765). Also preferred are polynucleotide fragments encoding these polypeptide fragments (See Genbank Accession No.R65208) The gene encoding the disclosed cDNA is believed to reside on chromosome 7. Accordingly, polynucleotides related to this invention are useful as a marker in linkage analysis for chromosome 7.

This gene is expressed primarily in the brain (infant brain, adult brain, pituitary, cerebellum, hippocampus, schizophrenic hypothalmus, amygdala).

Therefore, polynucleotides and polypeptides of the invention are useful as reagents for differential identification of the tissue(s) or cell type(s) present in a biological sample and for diagnosis of diseases and conditions which include, but are not limited to, developmental disorders and neurodegenerative diseases of the brain and nervous system, in addition to immune or hematopoietic disorders. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues or cell types (e.g., neural, developmental, immune, hematopoietic, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 321 as residues: Thr-25 to Lys-36, Lys-55 to Ser-63.

The tissue distribution primarily in brain, combined with the homology to the highly conserved SA-1 and SA-2 proteins, indicates that the protein product of this gene is useful for the detection and treatment of developmental, degenerative and behavioral conditions of the brain and nervous system (e.g. schizophrenia, depression, Alzheimer's disease, Parkinson's disease, Huntington's disease, mania, dementia, paranoia, addictive behavior and sleep disorders). Moreover, the protein product of this gene is useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:83 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1692 of SEQ ID NO:83, b is an integer of 15 to 1706, where both a and b correspond to the positions of nucleotide residues shown in SEQ ID NO:83, and where b is greater than or equal to a+14.

Features of Protein Encoded by Gene No: 74

In specific embodiments, polypeptides of the invention comprise the following amino acid sequence: EFGTSLVALELHELLYHWETRAQPSLI-LYVVSDLRWMEFRTSCLLFDFVLFLE (SEQ ID NO:766), TKPGMVGHVPIVPATKXAE-AGGSPEPGSSTLQWPMITPCTPSWATEPDHVSEDE (SEQ ID NO:767), and/or LLYHWETRAQPSLILYVVS-DLRWMEFRTSC (SEQ ID NO:768). Polynucleotides encoding these polypeptides are also encompassed by the invention.

This gene is expressed primarily in the hypothalamus of a human suffering from schizophrenia.

Therefore, polynucleotides and polypeptides of the invention are useful as reagents for differential identification of the tissue(s) or cell type(s) present in a biological sample and for diagnosis of diseases and conditions which include, but are not limited to, disorders of the CNS, particularly schizophrenia. Similarly, polypeptides and antibodies directed to these polypeptides are useful in providing immunological probes for differential identification of the tissue(s) or cell type(s). For a number of disorders of the above tissues or cells, particularly of the CNS, such as schizophrenia expression of this gene at significantly higher or lower levels may be routinely detected in certain tissues or cell types (e.g., neural, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 322 as residues: Gly-38 to Ala-44.

The tissue distribution in the hypothalamus indicates that the protein products of this gene are useful for the study, diagnosis and treatmenttof schizophrenia and other disorders involving the CNS. Moreover, the protein product of this gene is useful for the detection/treatment of neurodegenerative disease states, behavioural disorders, or inflamatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, mania, dementia, paranoia, obsessive compulsive disorder, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Moreover, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:84 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 559 of SEQ ID NO:84, b is an integer of 15 to 573, where both a and b correspond to the positions of nucleotide residues shown in SEQ ID NO:84, and where b is greater than or equal to a+14.

Features of Protein Encoded by Gene No: 75

Preferred polypeptides of the invention comprise the following amino acid sequence encoded by this gene: LAVSTSFICCADISTALPLGSSRPAPA-PRHREHEHGHQARPPRLLXTSLMPLST-PAAAQLLWTQLTPMGGRPG-GRHSPPTLHTGPRALPPGPPHPSLHVAALSLLR (SEQ ID NO:769), APAVPHQPPGTESTSMGTKPGLPGCSXR-PLCHYQHQLXPSYFGHSSPPWGAV-LVGVTPHPRCTPAPGPCRLGLHTHPCTWQLCLC (SEQ ID NO:770), CADISTALPLGSSRPAPAPRHREHEHGH (SEQ ID NO:771), WTQLTPMGGRPGGRHSPPTLHT-GPR (SEQ ID NO:772), and/or HQPPGTESTSMGTK-PGLPGC (SEQ ID NO:773). Polynucleotides encoding such polypeptides are also provided.

This gene is expressed primarily in endometrial tumors, and to a lesser extent, in amniotic cells.

Therefore, polynucleotides and polypeptides of the invention are useful as reagents for differential identification of the tissue(s) or cell type(s) present in a biological sample and for diagnosis of diseases and conditions which include, but are not limited to, reproductive, developmental, and immune disorders, particularly cancers of those systems. Similarly, polypeptides and antibodies directed to these polypeptides are useful in providing immunological probes for differential identification of the tissue(s) or cell type(s). For a number of disorders of the above tissues or cells, particularly of the reproductive and immune systems, expression of this gene at significantly higher or lower levels may be routinely detected in certain tissues or cell types (e.g., developmental, reproductive, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 323 as residues: Ser-3 to Arg-9.

The tissue distribution in endometrium and amniotic cells indicates that the protein products of this gene are useful for the study and treatment of developmental, reproductive, and immune disorders, particularly cancers of those systems. Moreover, the expression within embryonic tissue and other cellular sources marked by proliferating cells indicates that this protein may play a role in the regulation of cellular division, and may show utility in the diagnosis and treatment of cancer and other proliferative disorders. Similarly, developmental tissues rely on decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:85 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 670 of SEQ ID NO:85, b is an integer of 15 to 684, where both a and b correspond to the positions of nucleotide residues shown in SEQ ID NO:85, and where b is greater than or equal to a+14.

Features of Protein Encoded by Gene No: 76

In specific embodiments, polypeptides of the invention comprise the following amino acid sequence: SRGSLLPPHLPHRVVVRVHRGAKSLKALRQYIGAAHLQLPWDGKDPARPLGITLCLQMEIQVLG (SEQ ID NO:774), CCSFGFYYMVGSDTAEKQGPIPGSQTQEGPWLSRHTHSPRAVPESSTAPAQPLLLPLPAPQARRWASNANGWGWDHQREGQANYPYSARPAPHNLHPQYLNLHLQTQCYAQGSGWVLPIPGQLKVGGPYELPEGLQGLCSSVHPHNNPVR (SEQ ID NO:775), HRGAKSLKALRQYIGAAHLQLPWDG (SEQ ID NO:776), PAPQARRWASNANGWGWDHQR (SEQ ID NO:777), and/or HPQYLNLHLQTQCYAQGSGWVLP (SEQ ID NO:778). Polynucleotides encoding these polypeptides are also encompassed by the invention. The gene encoding the disclosed cDNA is believed to reside on chromosome 22. Accordingly, polynucleotides related to this invention are useful as a marker in linkage analysis for chromosome 22.

This gene is expressed primarily in kidney cortex, and to a lesser extent, in early stage human brain.

Therefore, polynucleotides and polypeptides of the invention are useful as reagents for differential identification of the tissue(s) or cell type(s) present in a biological sample and for diagnosis of diseases and conditions which include, but are not limited to, renal disorders such as renal cancer, developmental, or neural disorders, particularly cancers. Similarly, polypeptides and antibodies directed to these polypeptides are useful in providing immunological probes for differential identification of the tissue(s) or cell type(s). For a number of disorders of the above tissues or cells, particularly of the kidney expression of this gene at significantly higher or lower levels may be routinely detected in certain tissues or cell types (e.g., developmental, neural, renal, urogenital, endothelial, vascular, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 324 as residues: Gly-38 to Gly-45, Gly-47 to Gly-52, Pro-92 to Lys-110.

The tissue distribution in kidney cortex indicates that the protein products of this gene are useful for the study, treatment and diagnosis of renal diseases, including renal failure, nephritus, renal tubular acidosis, proteinuria, pyuria, edema, pyelonephritis, hydronephritis, nephrotic syndrome, crush syndrome, glomerulonephritis, hematuria, renal colic and kidney stones, in addition to Wilms Tumor Disease, and congenital kidney abnormalities such as horseshoe kidney, polycystic kidney, and Falconi's syndrome. Moreover, the expression within human brain indicates that the protein product of this gene is useful for the detection/treatment of neurodegenerative disease states, behavioural disorders, or inflamatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Moreover, the gene or gene product may also play a role in the treatment and/or detection of developmental disorders associated with the developing embryo, sexually-linked disorders, or disorders of the cardiovascular system. Furthermore, the protein product may also show utility in the treament and/or prevention of a variety of vascular disorders, particularly embolism, aneurysm, stroke, atherosclerosis, or microvascular disease. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:86 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides compris-

Features of Protein Encoded by Gene No: 77

In specific embodiments, polypeptides of the invention comprise the following amino acid sequence: TNGIMQYVTFCVWLILFSIMFLRFIQAVACISTSFLFLAEYYSIIWIYHNSFTYSSFVSAVWLL (SEQ ID NO:779), YNFMFNFSKNCQKVFHSGCIIYIPTGNVQGFLFFHILALTNTSFXXXFCFFIATLVDVKWHLIVLICISLMTNDIILFLCAYGSKVFPWRNVPSSPLPFQNLVICLLLFSFKKFWPGAVAHL (SEQ ID NO:780), CVTQARVQWRDLGSLQPPPPGFKRFSCLSLLSRXDYMHLPPRPANFCIFSKMGFHHVGQAGLEVLXSSDLPALASQSAXITGEPLRLARIS (SEQ ID NO:781), LILFSIMFLRFIQAVACISTSFLF (SEQ ID NO:783), and/or LPPRPANFCIFSKMGFHHVGQAGLE (SEQ ID NO:782). Polynucleotides encoding these polypeptides are also encompassed by the invention.

This gene is expressed primarily in kidney medulla.

Therefore, polynucleotides and polypeptides of the invention are useful as reagents for differential identification of the tissue(s) or cell type(s) present in a biological sample and for diagnosis of diseases and conditions which include, but are not limited to, metabolic and renal disorders. Similarly, polypeptides and antibodies directed to these polypeptides are useful in providing immunological probes for differential identification of the tissue(s) or cell type(s). For a number of disorders of the above tissues or cells, particularly of the metabolic and renal systems, expression of this gene at significantly higher or lower levels may be routinely detected in certain tissues or cell types (e.g., renal, urogenital, endocrine, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in kidney tissue indicates that the protein products of this gene are useful for study, treatment and diagnosis of metabolic and renal diseases and disorders. Moreover, this gene or gene product could be used in the treatment and/or detection renal failure, nephritus, renal tubular acidosis, proteinuria, pyuria, edema, pyelonephritis, hydronephritis, nephrotic syndrome, crush syndrome, glomerulonephritis, hematuria, renal colic and kidney stones, in addition to Wilms Tumor Disease, and congenital kidney abnormalities such as horseshoe kidney, polycystic kidney, and Falconi's syndrome. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:87 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 894 of SEQ ID NO:87, b is an integer of 15 to 908, where both a and b correspond to the positions of nucleotide residues shown in SEQ ID NO:87, and where b is greater than or equal to a+14.

Features of Protein Encoded by Gene No: 78

In specific embodiments, polypeptides of the invention comprise the following amino acid sequence: ALVPSPQQILPSCFSLMWQVTTKSALVFFKCIYIPFLSAPSLPRLENCLIFCSLDVQSQLVFLSSPPVAGVLFFFLLSPLGSKSCSTVEX (SEQ ID NO:784), and/or APSLPRLENCLIFCSLDVQSQLVFLS (SEQ ID NO:785). Polynucleotides encoding these polypeptides are also encompassed by the invention.

This gene is expressed in chronic synovitis and microvascular endothelium.

Therefore, polynucleotides and polypeptides of the invention are useful as reagents for differential identification of the tissue(s) or cell type(s) present in a biological sample and for diagnosis of diseases and conditions which include, but are not limited to, skeletal or vascualar disorders, such as arthritis and atherosclerosis. Similarly, polypeptides and antibodies directed to these polypeptides are useful in providing immunological probes for differential identification of the tissue(s) or cell type(s). For a number of disorders of the above tissues or cells, particularly of the vascular and skeletal systems, expression of this gene at significantly higher or lower levels may be routinely detected in certain tissues or cell types (e.g., skeletal, synovium, endothelial cells, vascular, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in synovium and microvascular endothelium indicates that the protein products of this gene are useful for study, diagnosis and treatment of arthritic and other inflammatory diseases as well as cardiovascular diseases. Moreover, the expression of this gene product in synovium would suggest a role in the detection and treatment of disorders and conditions affecting the skeletal system, in particular osteoporosis, bone cancer, as well as, disorders afflicting connective tissues (e.g. arthritis, trauma, tendonitis, chrondomalacia and inflammation), such as in the diagnosis or treatment of various autoimmune disorders such as rheumatoid arthritis, lupus, scleroderma, and dermatomyositis as well as dwarfism, spinal deformation, and specific joint abnormalities as well as chondrodysplasias (ie. spondyloepiphyseal dysplasia congenita, familial osteoarthritis, Atelosteogenesis type II, metaphyseal chondrodysplasia type Schmid). In addition, the protein would also be useful in the treatment and/or prevention of a variety of vascular disorders, which include, but are not limited to, miscorvascular disease, embolism, thrombosis, aneurysm, stroke, or atherosclerosis. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:88 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 641 of SEQ ID NO:88, b is an integer of 15 to 655, where both a and b correspond to the positions of nucleotide residues shown in SEQ ID NO:88, and where b is greater than or equal to a+14.

Features of Protein Encoded by Gene No: 79

In specific embodiments, polypeptides of the invention comprise the following amino acid sequence: SSPSRVRLRHTPG (SEQ ID NO:786), and/or SNTNYCFMFFYFPVKVLVPFKNCYILSLLILPCCICGHQFPRXQACTFCLHTLGGFSFSXLFLVLLSFYVQTGFSV (SEQ ID NO:787). Polynucleotides encoding these polypeptides are also encompassed by the invention.

This gene is expressed in resting T-cells and activated monocytes.

Therefore, polynucleotides and polypeptides of the invention are useful as reagents for differential identification of the tissue(s) or cell type(s) present in a biological sample and for diagnosis of diseases and conditions which include, but are not limited to, immune or hematopoietic disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematpoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in T-cells and monocytes indicates that the protein products of this gene are useful for the study and treatment of immune diseases such as inflammatory conditions. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis,,drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:89 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1088 of SEQ ID NO:89, b is an integer of 15 to 1102, where both a and b correspond to the positions of nucleotide residues shown in SEQ ID NO:89, and where b is greater than or equal to a+14.

Features of Protein Encoded by Gene No: 80

In specific embodiments, polypeptides of the invention comprise the following amino acid sequence: GTSRHGQRPIAPGTPWQREPRVEVMDPAGGPRGVLPRPCRXLVLLNPRGGKGKALQLFRSHVQPLLAEAEISFILMLTERRNHARELVRSEELGRWXALV VMXGDGLMHEVVNGLHGAA (SEQ ID NO:788), and/or RPIAPGTPWQREPRVEVMDPAGGP (SEQ ID NO:789). Polynucleotides encoding these polypeptides are also encompassed by the invention. The gene encoding the disclosed cDNA is believed to reside on chromosome 17. Accordingly, polynucleotides related to this invention are useful as a marker in linkage analysis for chromosome 17.

This gene is expressed in a variety of immune system tissues, e.g., neutrophils, T-cells, and TNF induced epithelial and endothelial cells.

Therefore, polynucleotides and polypeptides of the invention are useful as reagents for differential identification of the tissue(s) or cell type(s) present in a biological sample and for diagnosis of diseases and conditions which include, but are not limited to, infectious and immune or hematopoietic disorders. Similarly, polypeptides and antibodies directed to these polypeptides are useful in providing immunological probes for differential identification of the tissue(s) or cell type(s). For a number of disorders of the above tissues or cells, particularly of the immune and vascular systems, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 328 as residues: Met-1 to Trp-6.

The tissue distribution in immune tissues and cells indicates that the protein products of this gene are useful for the study and treatment of infectious diseases, immune and vascular disorders. Moreover, this gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:90 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1519 of SEQ ID NO:90, b is an integer of 15 to 1533, where both a and b correspond to the positions of nucleotide residues shown in SEQ ID NO:90, and where b is greater than or equal to a+14.

Features of Protein Encoded by Gene No: 81

In specific embodiments, polypeptides of the invention comprise the following amino acid sequence: ASGPLMGX-AVLKIFE (SEQ ID NO:790). Polynucleotides encoding these polypeptides are also encompassed by the invention.

This gene is expressed in activated neutrophils.

Therefore, polynucleotides and polypeptides of the invention are useful as reagents for differential identification of the tissue(s) or cell type(s) present in a biological sample and for diagnosis of diseases and conditions which include, but are not limited to, inflammation and other immune or hematopoietic conditions. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neutrophils indicates that the protein products of this gene are useful for the study and treatment of immune disorders. Moreover, this gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:91 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 561 of SEQ ID NO:91, b is an integer of 15 to 575, where both a and b correspond to the positions of nucleotide residues shown in SEQ ID NO:91, and where b is greater than or equal to a+14.

Features of Protein Encoded by Gene No: 82

In specific embodiments, polypeptides of the invention comprise the following amino acid sequence: LLRSALX-SPHLPTPVPLV (SEQ ID NO:791), QXRNLAQEAFK-WIPQDRPTVRSRXRMGLSIRLPILASNC-CALPFXXPTSPLQCLWSCHCSFQANTGLAS (SEQ ID NO:792), QMTQEPPTSVRAHGIAAWGNGCRDKNT-KRLIQYWPESCSGMTKGTVGRWGEXRAERSS (SEQ ID NO:793), and/or HGIAAWGNGCRDKNTKRLIQY (SEQ ID NO:794). Polynucleotides encoding these polypeptides are also encompassed by the invention.

This gene is expressed in neutrophils.

Therefore, polynucleotides and polypeptides of the invention are useful as reagents for differential identification of the tissue(s) or cell type(s) present in a biological sample and for diagnosis of diseases and conditions which include, but are not limited to, inflammatory and other immune or hematopoietic conditions. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 330 as residues: Ala-83 to Thr-91.

The tissue distribution in neutrophils indicates that the protein products of this gene are useful for the study and treatment of immune disorders. Moreover, the expression of this gene product in neutrophils indicates a role in the regulation of the proliferation; survival; differentiation; and/or activation of hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:92 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 625 of SEQ ID NO:92, b is an integer of 15 to 639, where both a and b correspond to the positions of nucleotide residues shown in SEQ ID NO:92, and where b is greater than or equal to a+14.

Features of Protein Encoded by Gene No: 83

In specific embodiments, polypeptides of the invention comprise the following amino acid sequence: CERSGYTR-MAMDT (SEQ ID NO:795), TGSILAVGKKYSLGSYS-RGDWHMRVVGLRGLGASTLQGLLIGIKP-NKPQGRGKLQGRSSRKDTVLWPSPEHPHMVSMAIL VYPDLSHYSNPHSTPAALLGCWPPFREGEILGLQR PGQWPEERCDRPWLPPC (SEQ ID NO:796), GSYS-RGDWHMRVVGLRGLGASTLQGLLIG (SEQ ID NO:797), and/or STPAALLGCWPPFREGEILGLQR-PGQW (SEQ ID NO:798). Polynucleotides encoding these polypeptides are also encompassed by the invention.

This gene is expressed in human neutrophils.

Therefore, polynucleotides and polypeptides of the invention are useful as reagents for differential identification of the tissue(s) or cell type(s) present in a biological sample and for diagnosis of diseases and conditions which include, but are not limited to, inflammation and immune or hematopoietic disorders. Similarly, polypeptides and antibodies directed to these polypeptides are useful in providing immunological probes for differential identification of the tissue(s) or cell type(s). For a number of disorders of the above tissues or cells, particularly of the immune and inflammatory system, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neutrophils indicates that the protein products of this gene are useful for diagnosis and treatment of disorders of the inflammatory and immune systems. Moreover, expression of this gene product in neutrophils indicates a role in the regulation of the proliferation; survival; differentiation; and/or activation of hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:93 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 844 of SEQ ID NO:93, b is an integer of 15 to 858, where both a and b correspond to the positions of nucleotide residues shown in SEQ ID NO:93, and where b is greater than or equal to a+14.

Features of Protein Encoded by Gene No: 84

In specific embodiments, polypeptides of the invention comprise the following amino acid sequence: TMGTWVD-WLTTNTAHTPAIAAAICAEDFPQRHCGSVERSPDQAC (SEQ ID NO:799), and/or TNTAHTPAIAAAICAEDF-PQRHC (SEQ ID NO:800). Polynucleotides encoding these polypeptides are also encompassed by the invention.

This gene is expressed in human neutrophils.

Therefore, polynucleotides and polypeptides of the invention are useful as reagents for differential identification of the tissue(s) or cell type(s) present in a biological sample and for diagnosis of diseases and conditions which include, but are not limited to, inflammatory and immune or hematopoietic disorders. Similarly, polypeptides and antibodies directed to these polypeptides are useful in providing immunological probes for differential identification of the tissue(s) or cell type(s). For a number of disorders of the above tissues or cells, particularly of the inflammatory and immune systems, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neutrophils indicates that the protein products of this gene are useful for diagnosis and treatment of disorders of the immune and inflammatory systems. Moreover, the expression of this gene product indicates a role in the regulation of the proliferation; survival; differentiation; and/or activation of hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:94 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 512 of SEQ ID NO:94, b is an integer of 15 to 526, where both a and b correspond to the positions of nucleotide residues shown in SEQ ID NO:94, and where b is greater than or equal to a+14.

Features of Protein Encoded by Gene No: 85

In specific embodiments, polypeptides of the invention comprise the following amino acid sequence: MSPETKGKGRSFPLK (SEQ ID NO:801), CQNKCSETTCGRTRRESNKQARAMAFIFKGKDLPFPFVSGDIQPKSSGSMAPDQQGLCYLGSWRSHLYCRLLPMDQVSPALC (SEQ ID NO:802), KPSPGLAYCSLSWSFHMLFLNICS-GITIPVILSSGPSHL-STLSLAVSPRRPGTWVKACSCWCP (SEQ ID NO:803), NKQARAMAFIFKGKDLPFPFVSGDI (SEQ ID NO:804), YLGSWRSHLYCRLLPMDQVSP (SEQ ID NO:805), and/or GITIPVILSSGPSHLSTLSLAVSPR (SEQ ID NO:806). Polynucleotides encoding these polypeptides are also encompassed by the invention.

This gene is expressed in activated neutrophils.

Therefore, polynucleotides and polypeptides of the invention are useful as reagents for differential identification of the tissue(s) or cell type(s) present in a biological sample and for diagnosis of diseases and conditions which include, but are not limited to, inflammation and immune or hematopoietic diseases. Similarly, polypeptides and antibodies directed to these polypeptides are useful in providing immunological probes for differential identification of the tissue(s) or cell type(s). For a number of disorders of the above tissues or cells, particularly of the immune system and inflammatory system, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neutrophils indicates that the protein products of this gene are useful for diagnosis and treatment of diseases of the inflammatory and immune systems. Moreover, the expression of this gene product indicates a role in the regulation of the proliferation; survival; differentiation; and/or activation of hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:95 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 412 of SEQ ID NO:95, b is an integer of 15 to 426, where both a and b correspond to the positions of nucleotide residues shown in SEQ ID NO:95, and where b is greater than or equal to a+14.

Features of Protein Encoded by Gene No: 86

In specific embodiments, polypeptides of the invention comprise the following amino acid sequence: LERLGVGRGLE (SEQ ID NO:807), DLPPCWTTLKE-HQCFMQYQLFTIQCKVVEQTICEDERK-MESTCLTLAXPESVRQXCPATLWSSMNIC (SEQ ID NO:808), and/or TNRVXLSWRKEEQRMGRTETGAKD-KGRDFLERGSRGWQLYTGAADTEEV (SEQ ID NO:809). Polynucleotides encoding these polypeptides are also encompassed by the invention.

This gene is expressed in activated neutrophils.

Therefore, polynucleotides and polypeptides of the invention are useful as reagents for differential identification of the tissue(s) or cell type(s) present in a biological sample and for diagnosis of diseases and conditions which include, but are not limited to, inflammation and immune system disorders. Similarly, polypeptides and antibodies directed to these polypeptides are useful in providing immunological probes for differential identification of the tissue(s) or cell type(s). For a number of disorders of the above tissues or cells, particularly of the inflammatory and immune system, expression of this gene at significantly higher or lower levels may be routinely detected in certain tissues or cell types (e.g., immune, hematopoietic; and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 334 as residues: Met-1 to Gly-6, Gly-32 to Pro-43, Leu-55 to Gln-60.

The tissue distribution in neutrophils indicates that the protein products of this gene are useful for diagnosis and treatment of disorders of the immune and inflammatory system. Moreover, the expression of this gene product indicates a role in the regulation of the proliferation; survival; differentiation; and/or activation of hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:96 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 830 of SEQ ID NO:96, b is an integer of 15 to 844, where both a and b correspond to the positions of nucleotide residues shown in SEQ ID NO:96, and where b is greater than or equal to a+14.

Features of Protein Encoded by Gene No: 87

In specific embodiments, polypeptides of the invention comprise the sequence: EQVLALLWPRFELILEMNVQS-VRSTDPQRLGGLDTRPHYITRRYAEFSSALVSI NQTIPNERTMQLLGQLQVEVENFVLRVAAEFSS RKEQLVFLNNYDMMLGVLMERAADDSKEVESFQ QLLNARTQEFIEELLSPPFGGLVAFVKE-AEALIERGQAERLRGEEARVTQLIRG-FGSSWKSSVESLSQDVMRSTNFRNGTSIIQG (SEQ ID NO:810), ALLKYRFFYQFLLGNERATAKEIRD-EYVETLSKIYLSYYRSYLGRLMKVQYE-EVAEKDDLMGVEDTAKKGFXSKPSL-RSRNTWTLGTRGSVISPTELEAPILVPHTAQR (SEQ ID NO:811), EQRYPFEALFRSQHYXLLDNSCREYL-FICEFFWSGPXAHDLF-HAVMGRTLSMTLKHLDSYLADCYDAIA-VFLCIHIVLRFRNIAAKRDVPALDRYW (SEQ ID NO:812), GGLDTRPHYITRRYAEFSSALVSINQ (SEQ ID NO:813), SRKEQLVFLINNYDMMLGVL (SEQ ID NO:814), ALLKYRFFYQFLLGNERATAKEIRD-EYVETLSKIYLSYYRSYLGRLMKVQYE-EVAEKDDLMGVEDTAKKGFXSKPSL-RSRNTIFTLGTRGSVISPTELEAPILVPHTAQRXEQRY PFEALFRSQHYXLLDNSCREYLFICEF-FVVSGPXAHDL FHAVMGRTLSMTLKHLDSYLADCY-DAIAVFLCVPALDR YWEQVLALLMPRELILEMN-VQSVRSTDPQRLGGLDTRP HYRIRRYAEFSSALVSINQTIPNERTMQLLGQLQVEVE NFVLRVAAEFSSRKEQLVFLINNYDM-MLGVLMERAADD SKEVESFQQLLNARTQEFIEELL-SPPFGGLVAFVKEAE ALIERGQAERLRGEEARVTQ-LIRGFGSSWKSSVESLSQ DVMRSFTNFRNGTS (SEQ ID NO:815), PADLRAVSGTSEVGLMLLELHHKVVN-VDELSPGREGSELRLGQHPVEAMIELD-QLGQRSLNDTGAISEVGETPHYILTQRFH (SEQ ID NO:816), and/or GPHPGASHSAAXEQRYPFEALFR-SQHYXLLDNSCREYLFICEFFVVSGPX-AHDLFHAVMGRTLSMTLKHLDSYLADCY-DAIAVFLCIHIVLRFRNIAAKRDVPALDRYWGTGAC LAMATV (SEQ ID NO:817). Polynucleotides encoding these polypeptides are also encompassed by the invention. The translation product of this gene shares sequence homology with a suppressor of actin mutation which is thought to be important in mutation suppression.

This gene is expressed primarily in fetal liver.

Therefore, polynucleotides and polypeptides of the invention are useful as reagents for differential identification of the tissue(s) or cell type(s) present in a biological sample and for diagnosis of diseases and conditions which include, but are not limited to, hepatic or metabolic conditions. Similarly, polypeptides and antibodies directed to these polypeptides are useful in providing immunological probes for differential identification of the tissue(s) or cell type(s). For a number of disorders of the above tissues or cells, particularly of the liver or cancer, expression of this gene at significantly higher or lower levels may be routinely detected in certain tissues or cell types (e.g., hepatic, metabolic, and cancerous and wounded tissues) or bodily fluids (e.g., lymph, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 335 as residues: Val-53 to Arg-60, Thr-88 to Thr-94, Ala-142 to Ser-150, Gly-188 to Glu-196, Gly-208 to Ser-214, Thr-227 to Gly-232, Lys-279 to Phe-285.

The tissue distribution in liver, combined with the homology to a highly conserved suppressor of actin mutation, suggest that the protein product of this gene is useful for dianosis and treament of liver disorders or cancer. Similarly, the protein product of this gene is useful for the detection and treatment of hepatoblastoma, jaundice, hepatitis, liver metabolic diseases and conditions that are attributable to the differentiation of hepatocyte progenitor cells. In addition the expression in fetus would suggest a useful role for the protein product in developmental abnormalities, fetal deficiencies, pre-natal disorders and various would-healing models and/or tissue trauma. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:97 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1971 of SEQ ID NO:97, b is an integer of 15 to 1985, where both a and b correspond to the positions of nucleotide residues shown in SEQ ID NO:97, and where b is greater than or equal to a+14.

Features of Protein Encoded by Gene No: 88

In specific embodiments, polypeptides of the invention comprise the sequence: YEGKEFDYVFSIDVNEG-GPSYKLPYNTSDDPWLTAYNFLQKNDL-NPMFLDQVAKFIIDNTKGQMLGLGNPS-FSDPFTGGGRYVPGSSGSSNTLPTADPFTGAGRYVPG SASMGTTMAGVDPFTGNSAYRSAASKTM-NIYFPKKEA VTFDQANPTQILGKLKELNGTAP-EEKKLTEDDLILLE KILSLICNSSSEKPTVQQLQILW-KAINCPEDIVFPAL DILRLSIKHPSVNENFCNEKEGAQFSSHLINLLNPKG KPANQLLALRTFC-NCFVGQAGQKLMMSQRESLMSHAI ELKSGSNKNI (SEQ ID NO:818), HIALATLALNYSVCFHKD (SEQ ID NO:819), HNIEGKAQCLSLISTILEVVQDLEATFR-LLVALGTLISDDSNAVQLAKS (SEQ ID NO:820), LGVDSQIKKYSSVSEPAKVSECCRFILNLL (SEQ ID NO:821), YEGKEFDYVFSIDVNEGGPSYKLPYNTS-DDPWLTAY NFLQKNDLNPMFLDQVAKFIIDNT-KGQMLGLGNPSF SDPFFGGGRYVPGSSGSSNTLPTADPFTGAGRYVPG SASMGTTMAGVDPFTGNSAYRSAASKTMNIYFPKKE AVTFDQANPTQILGKLKELNGTAPEEKKLTEDDLIL LEKILSLICNSSSEKPTVQQLQILWKAINCPEDIVF PALDILRLSIKHPSVNENFCNEKEGAQFSSHLINLL NPKGKPANQLLALRTFC-NCFVGQAGQKLMMSQRESL MSHAIELKSGSNKNI-HIALATLALNYSVCFHKDHNI EGKAQCLSLIS-TILEWQDLEATFRLLVALGTLISDD SNAVQLAKSLGVDSQIKKYSSVSEPAKVSECCRFIL NLL(SEQ ID NO:822), LNLLLITQKVKCWDLGIPAF-QIHLQVWG (SEQ ID NO:823), IKHPSVNENFCNEKEG-AQFSSHLINLLNP (SEQ ID NO:824), AIELKSGSNKN-IMIALATLALN (SEQ ID NO:825), VQLAKSLGVDSQIKKYSSVSEPA (SEQ ID NO:826), YEGKEFDYVFSIDVNEGGPSYKLPYN (SEQ ID NO:827), AYNFLQKNDLNPMFLDQVAKFIIDNT (SEQ ID NO:828), SFSDPFTGGGRYVPG (SEQ ID NO:829), TADPFTGAGRY (SEQ ID NO:830), TTMAGVDPFTGN-SAYRSAA (SEQ ID NO:831), NIYFPKKEA (SEQ ID NO:832), TFDQANPTQILGKLKELNG (SEQ ID NO:833), PEDIVFPALDILRLSIKHPSVNENFCNEKE (SEQ ID NO:834), QFSSHLINLLNPKGKPANQLLALRTFCNCFV (SEQ ID NO:835), and/or QAGQKLMMSQRESLM-SHAIELKSGSN (SEQ ID NO:836). Polnynucleotides encoding these polypeptides are also encompassed by the invention. These polypeptides share significant homology with phospholipase A2 activating protein, which is thought to be important in signal transduction (see, e.g., Wang et al., Gene 161(2):237–241 (1995)). The gene encoding the disclosed cDNA is believed to reside on chromosome 9. Accordingly, polynucleotides related to this invention are useful as a marker in linkage analysis for chromosome 9.

This gene is expressed primarily in endothelial cells, to a less extent in placenta, endometrial stromal cells, osteosarcoma, testis tumor, muscle, and infant brain that are likely to be rich in blood vessles.

Therefore, polynucleotides and polypeptides of the invention are useful as reagents for differential identification of the tissue(s) or cell type(s) present in a biological sample and for diagnosis of diseases and conditions which include, but are not limited to, disorders of the vascular system, aberrent angiogenesis, tumor angiogenesis, or related disorders of endothelial tissues. Similarly, polypeptides and antibodies directed to these polypeptides are useful in providing immunological probes for differential identification of the tissue(s) or cell type(s). For a number of disorders of the above tissues or cells, particularly of the vascular system or tumors, expression of this gene at significantly higher or lower levels may be routinely detected in certain tissues or cell types (e.g., endothelial, placenta, skeletal, neural, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution of this gene in endothelial cells and several potential highly vascularized tissues, combined with the homology to the highly conserved phospholipase A2 activating protein suggest that this gene may be involved in transducing signals for endothelial cells in angiogenesis or vasculogenesis. Furthermore, the protein may show utility for the treatment, and/or prevention of embolism, thrombosis, aneurysm, atherosclerosis, microvascular disease, or stroke. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:98 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1402 of SEQ ID NO:98, b is an integer of 15 to 1416, where both a and b correspond to the positions of nucleotide residues shown in SEQ ID NO:98, and where b is greater than or equal to a+14.

Features of Protein Encoded by Gene No: 89

In specific embodiments, polypeptides of the invention comprise the sequence: YPNQDGDILRDQVLHEHIQRL-SKVVTANHRALQIPE VYLREAPWPSAQSEIRTISAYK-TPRDKVQCILRMCS TIMNLLSLANEDSVPGAD- DFVPVLVFVLIKANPPCLLSTVQYISSFYASCLSGE ESYWWMQFTAAVE(SEQ ID NO:837), YPNQDGDIL-RDQVLHEHIQRLSKYVTANHRALQIPE-VYLREAPWPSAQSEIRTISAYKTPRD-KVQCILRMCSIMNLLSLANEDSVPGADDFVPVLVFV LIKANPPCLLSTVQYISSFYASCLSGEESYWWMQFT AAVEFIKTI (SEQ ID NO:838), YPNQDGDILRDQVL (SEQ ID NO:839), EAPWPSAQSEI (SEQ ID NO:840), PVLVFVLIKANP (SEQ ID NO:845), SGEESYWWMQFI-AAVEFIKTI (SEQ ID NO:841), ADDFVPVLVFVLI-KANPP (SEQ ID NO:842), YKTPRDKVQCIL (SEQ ID NO:843), and/or GADDFVPVLVFVLIK (SEQ ID NO:844). The translation product of this gene shares sequence homology with human ras inhibitor and yeast VPS9p which is thought to be important in golgi vacuole transport. The gene encoding the disclosed cDNA is believed to reside on chromosome 9. Accordingly, polynucleotides related to this invention are useful as a marker in linkage analysis for chromosome 9.

This gene is expressed primarily in T cells and melanocytes.

Therefore, polynucleotides and polypeptides of the invention are useful as reagents for differential identification of the tissue(s) or cell type(s) present in a biological sample and for diagnosis of diseases and conditions which include, but are not limited to, immune, hematopoietic, or integumentary disorders, such as dysfunctions and disorders involving T cells and melanocytes. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in T-cells and melanocytes, combined with the homology to a ras inhibitor, indicates that the protein product of this gene is useful for regulating signal transduction; the diagnosis and treatment of disorders involving T cells and melanocytes, and potentially in the prevention or study of immune responses to aberrant integumentary cells and tissues, particularly in tumors and cancers, such as skin cancers. Moreover, the protein product of this gene is useful for the treatment, diagnosis, and/or prevention of various skin disorders including congenital disorders (i.e. nevi, moles, freckles, Mongolian spots, hemangiomas, portwine syndrome), integumentary tumors (i.e. keratoses, Bowen's disease, basal cell carcinoma, squamous cell carcinoma, malignant melanoma, Paget's disease, mycosis fungoides, and Kaposi's sarcoma), injuries and inflammation of the skin (i.e.wounds, rashes, prickly heat disorder, psoriasis, dermatitis), atherosclerosis, uticaria, eczema, photosensitivity, autoimmune disorders (i.e. lupus erythematosus, vitiligo, dermatomyositis, morphea, scleroderma, pemphigoid, and pemphigus), keloids, striae, erythema, petechiae, purpura, and xanthelasma. In addition, such disorders may predispose increased susceptibility to viral and bacterial infections of the skin (i.e. cold sores, warts, chickenpox, molluscum contagiosum, herpes zoster, boils, cellulitis, erysipelas, impetigo, tinea, althletes foot, and ringworm). Moreover, the protein product of this gene may also be useful for the treatment or diagnosis of various connective tissue disorders such as arthritis, trauma, tendonitis, chrondomalacia and inflammation, autoimmune disorders such as rheumatoid arthritis, lupus, scleroderma, and dermatomyositis as well as dwarfism, spinal deformation, and specific joint abnormalities as well as chondrodysplasias (ie. spondyloepiphyseal dysplasia congenita, familial osteoarthritis, Atelosteogenesis type II, metaphyseal chondrodysplasia type Schmid). Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:99 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1746 of SEQ ID NO:99, b is an integer of 15 to 1760, where both a and b correspond to the positions of nucleotide residues shown in SEQ ID NO:99, and where b is greater than or equal to a+14.

Features of Protein Encoded by Gene No: 90

The translation product of this gene shares sequence homology with neuronal olfactomedin-related ER localized protein which is thought to be important in the maintenance, growth, or differentiation of chemosensory cilia on the apical dendrites of olfactory neurons. Moreover, the protein also shares homology with the conserved human AMY protein which is thought to be a glial cell-specific transforming protein. In specific embodiments, polypeptides of the invention comprise the sequence: SARASTQPPAGQH-PGPC (SEQ ID NO:846), MPGRWRWQRDMH-PARKLLSLLFLILMGTELTQD (SEQ ID NO:847), SAAP-DSLLRSSKGSTRGSL (SEQ ID NO:848), AAIVIWRGKSESRIAKTPGI (SEQ ID NO:849), FRGGGTLVLPPTHTPEWLIL (SEQ ID NO:852), PLGRT-MPLGAPETGGGD (SEQ ID NO:850), NSARASTQP-PAGQHPGPCMPGRWRWQRD (SEQ ID NO:853), YIVQGTTSPFEMPTIPTPARHRAPHSP-PAGHVATAPQALHIKPAMH-TAGRHAGCPSRSQRHNPHRLFLEPPRAALCPKGG (SEQ ID NO:854), ASNAHSWPARWLPFQVSAAQSPP-PVSGAPKGSVMPKGRMSHSGVCVGGRT-KVPPPLKMPGVLAIRLSLFPLQM-TIAAKDPLVLPFELLSRESGAAES (SEQ ID NO:855), GRMSHSGVCVGGRTKVPPPLKMPGVLA (SEQ ID NO:856), and/or CAAETWKGSQRAGQLCALLA (SEQ ID NO:851). The gene encoding the disclosed cDNA is believed to reside on chromosome 9. Accordingly, polynucleotides related to this invention are useful as a marker in linkage analysis for chromosome 9.

This gene is expressed in pineal gland.

Therefore, polynucleotides and polypeptides of the invention are useful as reagents for differential identification of the tissue(s) or cell type(s) present in a biological sample and for diagnosis of diseases and conditions which include, but are not limited to, neurological and endocrinological disorders. Similarly, polypeptides and antibodies directed to these polypeptides are useful in providing immunological probes for differential identification of the tissue(s) or cell type(s). For a number of disorders of the above tissues or cells, particularly of the neurological or endocrine systems, expression of this gene at significantly higher or lower levels may be routinely detected in certain tissues or cell types (e.g., neural, endocrine, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 338 as residues: Leu-20 to Ala-26, Arg-32 to Arg-39, Thr-104 to Gly-112.

The tissue distribution in pineal gland, combined with the homology to both the olfactomedin-related, and AMY proteins, indicates that the protein product of this gene is useful for maintenance, growth, or differentiation of neuron cells in pineal gland. Therefore, the protein product of this gene may be useful for the diagnosis and treament of neurological disorders in pineal gland. Moreover, the protein product of this gene is useful for the detection/treatment of neurodegenerative disease states, behavioural disorders, or inflamatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Moreover, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:100 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 585 of SEQ ID NO:100, b is an integer of 15 to 599, where both a and b correspond to the positions of nucleotide residues shown in SEQ ID NO:100, and where b is greater than or equal to a+14.

Features of Protein Encoded by Gene No: 91

This gene is expressed primarily in prostate and apoptotic T cells.

Therefore, polynucleotides and polypeptides of the invention are useful as reagents for differential identification of the tissue(s) or cell type(s) present in a biological sample and for diagnosis of diseases and conditions which include, but are not limited to, reproductive, immune, or hematopoietic disorders, particularly prostate disease and T cell dysfunction. Similarly, polypeptides and antibodies directed to these polypeptides are useful in providing immunological probes for differential identification of the tissue(s) or cell type(s). For a number of disorders of the above tissues or cells, particularly of the prostate cancer, expression of this gene at significantly higher or lower levels may be routinely detected in certain tissues or cell types (e.g. prostate, immune, cancerous and wounded tissues) or bodily fluids (e.g., lymph, seminal fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in prostate and T-cells indicates that the protein product of this gene is useful for the detection of abnormal activity in prostate and T cells, such as proliferative conditions of the prostate, or possibly treatment of this abnormality. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:101 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 770 of SEQ ID NO:101, b is an integer of 15 to 784, where both a and b correspond to the positions of nucleotide residues shown in SEQ ID NO:101, and where b is greater than or equal to a+14.

Features of Protein Encoded by Gene No: 92

The gene encoding the disclosed cDNA is believed to reside on chromosome 19. Accordingly, polynucleotides related to this invention are useful as a marker in linkage analysis for chromosome 19.

This gene is expressed primarily in prostate, and to a lesser extent, in smooth muscle cells, fibroblasts, and placenta.

Therefore, polynucleotides and polypeptides of the invention are useful as reagents for differential identification of the tissue(s) or cell type(s) present in a biological sample and for diagnosis of diseases and conditions which include, but are not limited to, disorders in prostate or vascular tissues. Similarly, polypeptides and antibodies directed to these polypeptides are useful in providing immunological probes for differential identification of the tissue(s) or cell type(s). For a number of disorders of the above tissues or cells, particularly of the prosate or vascular system, expression of this gene at significantly higher or lower levels may be routinely detected in certain tissues or cell types (e.g. prostate, musculo-skeletal, cancerous and wounded tissues) or bodily fluids (e.g., lymph, seminal fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 340 as residues: Ser-38 to Lys-46.

The tissue distribution in prostate and smooth muscle indicates that the protein product of this gene is useful for regulating the function of prostate or highly vascularized tissues, such as the placenta. Similarly, the protein product of this gene may be useful in the treatment and/or detection of vascular disorders which include, but are not limited to, stroke, embolism, thrombosis, aneurysm, microvascular disease, or atherosclerosis. The protein may also show utility in the treatment or detection of proliferative disorders of the prostate or male reproductive system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:102 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 390 of SEQ ID NO:102, b is an integer of 15 to 404, where both a and b correspond to the positions of nucleotide residues shown in SEQ ID NO:102, and where b is greater than or equal to a+14.

Features of Protein Encoded by Gene No: 93

In specific embodiments, polypeptides of the invention comprise the following amino acid sequence: GHQTAPETPSRSD (SEQ ID NO:857). Polynucleotides encoding these polypeptides are also encompassed by the invention.

This gene is expressed primarily in embryos and fetal tissues, and to a lesser extent, in proliferative tissues.

Therefore, polynucleotides and polypeptides of the invention are useful as reagents for differential identification of the tissue(s) or cell type(s) present in a biological sample and for diagnosis of diseases and conditions which include, but are not limited to, disorders in embryonic development and cell proliferation. Similarly, polypeptides and antibodies directed to these polypeptides are useful in providing immunological probes for differential identification of the tissue(s) or cell type(s). For a number of disorders of the above tissues or cells, particularly of the embryonic tissues and proliferative cells, expression of this gene at significantly higher or lower levels may be routinely detected in certain tissues or cell types (e.g., developmental, differentiating, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in embryonic and fetal tissues indicates that the protein product of this gene is useful for the diagnosis or treatment of abnormalities in developing and proliferative cells and organs. Similarly, expression within embryonic tissue and other cellular sources marked by proliferating cells indicates that this protein may play a role in the regulation of cellular division, and may show utility in the diagnosis and treatment of cancer and other proliferative disorders. Similarly, developmental tissues rely on decisions involving cell differentiation and/or apoptosis in pattern formation. Thus, this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:103 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2204 of SEQ ID NO:103, b is an integer of 15 to 2218, where both a and b correspond to the positions of nucleotide residues shown in SEQ ID NO:103, and where b is greater than or equal to a+14.

Features of Protein Encoded by Gene No: 94

The translation product of this gene shares sequence homology with a transformation related protein which is thought to be important in transformation. In specific embodiments, polypeptides of the invention comprise the following amino acid sequence: SQTDR (SEQ ID NO:858). Polynucleotides encoding these polypeptides are also encompassed by the invention.The gene encoding the disclosed cDNA is believed to reside on chromosome 2. Accordingly, polynucleotides related to this invention are useful as a marker in linkage analysis for chromosome 2.

This gene is expressed primarily in female reproductive tissues, i.e., breast cancer cells, placenta, and ovary, and to a lesser extent, in fetal lung.

Therefore, polynucleotides and polypeptides of the invention are useful as reagents for differential identification of the tissue(s) or cell type(s) present in a biological sample and for diagnosis of diseases and conditions which include, but are not limited to, cancer or dysfunction of reproductive tissues, in addition to pulmonary or developmental disorders. Similarly, polypeptides and antibodies directed to these polypeptides are useful in providing immunological probes for differential identification of the tissue(s) or cell type(s). For a number of disorders of the above tissues or cells, particularly of the reproduction system, expression of this gene at significantly higher or lower levels may be routinely detected in certain tissues or cell types (e.g., pulmonary, reproductive, ovarian, breast, placental, develpomental, and cancerous and wounded tissues) or bodily fluids (e.g., lymph, pulmonary surfactant or sputum, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 342 as residues: Ser-50 to Pro-61.

The tissue distribution in female reproductive tissues, combined with the homology to the transformation related protein, indicates that the protein product of this gene is useful for the diagnosis and treatment of conditions caused by transformation, i.e. tumorigenesis in reproductive organs, (e.g. breast, placenta, and ovary). Similarly, expression within fetal tissue and other cellular sources marked by proliferating cells indicates that this protein may play a role in the regulation of cellular division, and may show utility in the diagnosis and treatment of cancer and other proliferative disorders. Similarly, developmental tissues rely on decisions involving cell differentiation and/or apoptosis in pattern formation. Thus this protein may also be involved in apoptosis or tissue differentiation and could again be useful in cancer therapy. Protein may also be useful in the treatment or detection of a variety of pulmonary conditions, including, but not limited to emphysema, ARDS, cystic fibrosis, asthma, etc. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:104 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1337 of SEQ ID NO:104, b is an integer of 15 to 1351, where both a and b correspond to the positions of nucleotide residues shown in SEQ ID NO:104, and where b is greater than or equal to a+14.

Features of Protein Encoded by Gene No: 95

In specific embodiments, polypeptides of the invention comprise the following amino acid sequence: NIYFKEKRKRGGAKMAGAIIEN (SEQ ID NO:859), VYLCAYTSTIVVTVTTANAKLINMCCLVDSN-TRSCVVIDEGIFRSAEQFLIKFRNKQSTIFPRFFWELHSIGLVFSIVFMGWCIQEHQSKDIQIPHPI-DACEKGTVHLD CDAAPFPMAFRYLTNDEEDDSHG-SAGQGDKHEELEPKN (SEQ ID NO:860), KMPCRMSP-NSSIQVQSNPMENHSTGILIKVMEIPRAKMTFSRSTG GRDIMVILLQYHTIMMKMLGVRKVF-MANHTLVKPPFW WIPTNRISFISPIPTLIFFFSFTG-SRMFKR (SEQ ID NO:861), TTKSEKMQKSPWTEP-WLTVMTHLLSGLKWPMKEYHGNSNAPSHLPRLQS MRAVTMNVMSFLSWKLGLWPISFTF (SEQ ID NO:862), IKFRNKQSTIFPRFTWELHSIGLVFSIVFMG (SEQ ID NO:863), SSIQVQSNPMENHSTGI-LIKVMEIPRAKM (SEQ ID NO:864), and/or LGVRKVF-MANHTLVKPPFWWIPTNRISFISPIP (SEQ ID NO:865). Polynucleotides encoding these polypeptides are also encompassed by the invention. The gene encoding the disclosed cDNA is believed to reside on chromosome 1. Accordingly, polynucleotides related to this invention are useful as a marker in linkage analysis for chromosome 1.

This gene is expressed primarily in testes, rhabdomyosarcoma, infant brain and to a lesser extent in some tumors and highly vascularized tissues.

Therefore, polynucleotides and polypeptides of the invention are useful as reagents for differential identification of the tissue(s) or cell type(s) present in a biological sample and for diagnosis of diseases and conditions which include, but are not limited to, tumorigenesis, abnormal angiogenesis, reproductive, vascular, and/or neurological disorders., Similarly, polypeptides and antibodies directed to these polypeptides are useful in providing immunological probes for differential identification of the tissue(s) or cell type(s). For a number of disorders of the above tissues or cells, particularly of the tumor tissues or vascular tissues, expression of this gene at significantly higher or lower levels may be routinely detected in certain tissues or cell types (e.g., muscle, neural, developmental, vascular, reproductive, testicular, and cancerous and wounded tissues) or bodily fluids (e.g., lymph, serum, seminal fluid, amniotic fluid, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 343 as residues: Arg-46 to Trp-54, Pro-60 to Ile-69, Asn-116 to Ala-122, Arg-147 to Lys-153, Ser-158 to Glu-170, Ile-399 to Ser-405, Pro-486 to Met-499, Pro-502 to Asp-508.

The tissue distribution in infant brain indicates that the protein product of this gene is useful for a range of disease states including treatment of tumor or vascular disorders and the treatment of neurological disorders such as Alzheimers Disease, Parkinsons Disease, Huntingtons Disease, schizophrenia, mania, dementia,paranoia, obsessive compulsive disorder and panic disorder. Moreover, expression within vascular tissues indicates that the protein product of this gene is useful in the treatment and/or detection of a variety of vascular conditions, which include but are not limited to emphysema, atherosclerosis, thrombosis, microvascular disease, stroke or aneurysm. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:105 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2052 of SEQ ID NO:105, b is an integer of 15 to 2066, where both a and b correspond to the positions of nucleotide residues shown in SEQ ID NO:105, and where b is greater than or equal to a+14.

Features of Protein Encoded by Gene No: 96

The translation product of this gene is homologous to the Clostridium perfringens enterotoxin (CPE) receptor gene product and shares sequence homology with a human ORF specific to prostate and a glycoprotein specific to oligodendrocytes, both of which are tissue specific proteins. See e.g., Katahira et al.J Cell Biol. 136(6):1239–1247 (1997). PMID: 9087440; UI: 97242441. In specific embodiments, polypeptides of the invention comprise the following amino acid sequence: TMASMGLQV (SEQ ID NO:866), KSWMMLWAVQDTGTITIRPANRNTTPATIMVLALAL SSSRQLVHLPTDSSTPRAATMMLMMTRARAACRSCG SASSESYTLHCIWPVLCTTQFIHRPSQMVCEVTMLL PMKAVTRHMGSAQHSMTASQPRTASAMPITCSPMEA IVQRPRELRTWKAEGIRLWGP(SEQ ID NO:867), LQVMGIALAVLGWLAVMLCCALPMWRVT (SEQ ID NO:868), SNIVTSQTIWEGLWMNCVVQST (SEQ ID NO:869), QMQCKVYDSLLALPQDLQ (SEQ ID NO:870), KCTNCLEDESAKAKTMIV (SEQ ID NO:871), GVVFLLAGLMVIVPVSWTAHNIIQDFYNPLVA (SEQ ID NO:872), and/or CCNCPPRTDKPY (SEQ ID NO:873). Polynucleotides encoding these polypeptides are also encompassed by the invention. The gene encoding the disclosed cDNA is believed to reside on chromosome 7. Accordingly, polynucleotides related to this invention are useful as a marker in linkage analysis for chromosome 7.

This gene is expressed primarily in pancreas tumor and ulcerative colitis, and to a lesser extent in several tumors and normal tissues.

Therefore, polynucleotides and polypeptides of the invention are useful as reagents for differential identification of the tissue(s) or cell type(s) present in a biological sample and for diagnosis of diseases and conditions which include, but are not limited to, metabolic, gastrointestinal, or proliferative disorders, such as pancreatic disorders, ulcerative colitis, tumors and food poisoning. Similarly, polypeptides and antibodies directed to these polypeptides are useful in providing immunological probes for differential identification of the tissue(s) or cell type(s). For a number of disorders of the above tissues or cells, particularly of the digestive system or tumorigenic system, expression of this gene at significantly higher or lower levels may be routinely detected in certain tissues or cell types (e.g., metabolic, gastrointestinal, pancreatic, and cancerous and wounded tissues) or bodily fluids (e.g., lymph, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 344 as residues: Gly-147 to Met-152, Cys-177 to Lys-188.

The tissue distribution in pancrease, combined with the homology to a prostate and oligodendrocyte-specific protein, indicates that the protein product of this gene is useful as a marker for the diagnosis or treatment of disorders in pancrease, ulcerative colitis, and tumors. Furthermore, identity to the human receptor for Clostridium perfringenes enterotoxin indicates that the soluble portion of this receptor could be used in the treatment of food poisoning associated with Clostridia perfringens by blocking the activity of the perfringens enterotoxin. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:106 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1691 of SEQ ID NO:106, b is an integer of 15 to 1705, where both a and b correspond to the positions of nucleotide residues shown in SEQ ID NO:106, and where b is greater than or equal to a+14.

Features of Protein Encoded by Gene No: 97

The translation product of this gene shares sequence homology with an ATPase from Saccharomyces cerevisiae which is thought to be important in metabolism (See Genbank Accession No.g81253). In specific embodiments, polypeptides of the invention comprise the following amino acid sequence: PFFAIAGSEIFSLE (SEQ ID NO:874), SKTEALTQAFR (SEQ ID NO:875), VVHTVSLBEIDVIN-SRTQGFLALF (SEQ ID NO:876), PGVLFIDEVHMLDIE (SEQ ID NO:877), AGIRQRFSARLWQLVS IMATVTAT-TKVPEIRDVTRIERIGAHSHIRGLGLDDAL EPRQASQGMVGQLAARRAAGVV-LEMIREGKIAGRAVLI AGQPGTGKTAIAMGMAQAL-GPDTPFFAIAGSEIFSLEM SKTEALTQAFRRSIGVRI-KEETEIIEGEVVEIQIDRPA TGTGSKVGKLTLKTTEMETIYDLGTK-MIXSLTKDKVQA GDVITIDKATGKISKLGRS-FTRARELRRYGLPDQVRAV PRWGAPETQGGGAHRVPARDRRHQLSHPGLPGALLR (SEQ ID NO:878), SPSTRRRARSPSWAAPS HAPANY-DAMGSQTKFVQCPDGELQKRKEVVHTVS LHEIDVINSRTQGFLALFSGDTGEIKSEVREQIN AKVAEWREEGKAEIIPGVLFIDEVHMLDIESFSF LNRALESDMAPVQQVYGDAVRALVAGAPDSRDAT VGGLVPNSCSPGDPLVLERPPPRWXS(SEQ ID NO:879), WIPRAAGIRHEATNRGITRIRGTSYQS PHGIPIDLLDRRHVTLQGPVEEGEALDVQHVDLVDE QHSRDDLRLALLAPLSHLGIDLLTDF(SEQ ID NO:880), YDAMGSQTKFVQCPDGELQKRKEVVHTVSL (SEQ ID NO:881), KAEIIPGVLFIDEVHMLDIESFSFLN-RALES (SEQ ID NO:882), and/or EATNRGITRIR-GTSYQSPHGIPIDLLDR (SEQ ID NO:883). Polynucleotides encoding these polypeptides are also encompassed by the invention.

This gene is expressed primarily in testes and several hematopoietic cells.

Therefore, polynucleotides and polypeptides of the invention are useful as reagents for differential identification of the tissue(s) or cell type(s) present in a biological sample and for diagnosis of diseases and conditions which include, but are not limited to, reproductive, immune, or hematopoietic disorders, particularly male infertility and leukemia. Similarly, polypeptides and antibodies directed to these polypeptides are useful in providing immunological probes for differential identification of the tissue(s) or cell type(s). For a number of disorders of the above tissues or cells, particularly of the hematopoietic system, expression of this gene at significantly higher or lower levels may be routinely detected in certain tissues or cell types (e.g., reproductive, immune, hematopoietic, testicular, and cancerous and wounded tissues) or bodily fluids (e.g., lymph, seminal fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in testes and hematopoietic cells, combined with the homology to ATPases, indicates that the protein product of this gene is useful as a marker for the diagnosis and treatment of leukemia and other hematopoietic disorders. The protein may also show utility as a contraceptive, or for the treatment and/or detection of aberrant testicular function. The secreted protein can also be used to determine biological activity, to raise antibodies, as tissue markers, to isolate cognate ligands or receptors, to identify agents that modulate their interactions and as nutritional supplements. It may also have a very wide range of biological acitivities. Typical of these are cytokine, cell proliferation/differentiation modulating activity or induction of other cytokines; immunostimulating/immunosuppressant activities (e.g. for treating human immunodeficiency virus infection, cancer, autoimmune diseases and allergy); regulation of hematopoiesis (e.g. for treating anaemia or as adjunct to chemotherapy); stimulation or growth of bone, cartilage, tendons, ligaments and/or nerves (e.g. for treating wounds); stimulation of follicle stimulating hormone (for control of fertility); chemotactic and chemokinetic activities (e.g. for treating infections, tumors); hemostatic or thrombolytic activity (e.g. for treating haemophilia, cardiac infarction etc.); anti-inflammatory activity (e.g. for treating septic shock, Crohn's disease); as antimicrobials; for treating psoriasis or other hyperproliferative diseases; for regulation of metabolism, and behaviour. Also contemplated is the use of the corresponding nucleic acid in gene therapy procedures. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:107 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1153 of SEQ ID NO:107, b is an integer of 15 to 11 67, where both a and b correspond to the positions of nucleotide residues shown in SEQ ID NO:107, and where b is greater than or equal to a+14.

Features of Protein Encoded by Gene No: 98

In specific embodiments, polypeptides of the invention comprise the sequence: MRSARPSLGCLPSWAFSQALNI (SEQ ID NO:884), LLGLKGLAPAEISAVCEGNFN (SEQ ID NO:885), VAHGLAWSYYIGYLRLILPELQARIR (SEQ ID NO:886),TYNQHYNNLLRGAVSQRC (SEQ ID NO:887), ILLPLDCGVPDNLSMADPNIRFLD-KLPQQTGDRAGIKDRVYSN (SEQ ID NO:888), SIYEL-LENGQRAGTCVLEYATPLQTLFAM-SQYSQAGFSGEDRLEQ (SEQ ID NO:889), AKLFCRTLEDILADAPESQNNCR-LIAYQEPADDSSFSLSQEVLRHLRQEE-KEEVTVGSLKTSAVPSTSTMSQEPEL-LISGMEKPLPLRTDFS (SEQ ID NO:890), LRLHSEKLPLAARSAGPSLLVI-IQSSQCPGGRRYRGSYWRTVRACLGCPL-RRGALLLLSIYFYYSLPNAVGPPFTW (SEQ ID NO:892), VWLTPTFASWINCPSRPVTVLASRIG-FTATASMSFWRTGSGRAPVSWSTPPPCR-LCLPCHNTVKLALAGRIGLSRPNS-SAGHLRTSWQMPLSLRTTAASLPTRNLQMTAASRCP RRFSGTCGRRKRKRLLWAA (SEQ ID NO:893), GVC-QVSFMGPSRPTPHPSPLPLPGDAELSQW-YQQAPSPSGSWSCSIIGEPQQKNGEEEE-AEFGVLNPPAPTLQHQGCYGLSCRATLA (SEQ ID NO:894), and/or LLGLKGLAPAEISAVCEKGNFNVAH-GLAWSYYIGYLRLILPEL (SEQ ID NO:891). Polynucleotides encoding these polypeptides are also encompassed by the invention.

This gene is expressed primarily in prostate BPH, and to a lesser extent, in bone marrow.

Therefore, polynucleotides and polypeptides of the invention are useful as reagents for differential identification of the tissue(s) or cell type(s) present in a biological sample and for diagnosis of diseases and conditions which include, but are not limited to, reproductive, hematopoietic, or immune disorders, particularly benign prostatic hypertrophy, prostate cancer, or leukemia. Similarly, polypeptides and antibodies directed to these polypeptides are useful in providing immunological probes for differential identification of the tissue(s) or cell type(s). For a number of disorders of the above tissues or cells, particularly of the male urinary system, expression of this gene at significantly higher or lower levels may be routinely detected in certain tissues or cell types (e.g., reproductive, hematopoietic, immune, prostatic, and cancerous and wounded tissues) or bodily fluids (e.g., lymph, seminal fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 346 as residues: Ile-60 to Asn-69, Leu-106 to Asp-112, Glu-130 to Gly-136, Phe-160 to Glu-167, Pro-184 to Cys-190, Glu-197 to Ser-202, Arg-215 to Glu-221, Thr-237 to Pro-242.

The tissue distribution in prostate tissue indicates that the protein product of this gene is useful for the diagnosis or treatment of reproductive disorders, such as benign prostatic hypertrophy or prostate cancer. Moreover, the protein product of this gene is useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:108 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1893 of SEQ ID NO:108, b is an integer of 15 to 1907, where both a and b correspond to the positions of nucleotide residues shown in SEQ ID NO:108, and where b is greater than or equal to a+14.

Features of Protein Encoded by Gene No: 99

The gene encoding the disclosed cDNA is believed to reside on chromosome 15. Accordingly, polynucleotides related to this invention are useful as a marker in linkage analysis for chromosome 15.

This gene is expressed primarily in salivary gland.

Therefore, polynucleotides and polypeptides of the invention are useful as reagents for differential identification of the tissue(s) or cell type(s) present in a biological sample and for diagnosis of diseases and conditions which include, but are not limited to, metabolic disorders, particularly of the salivary gland. Similarly, polypeptides and antibodies directed to these polypeptides are useful in providing immunological probes for differential identification of the tissue(s) or cell type(s). For a number of disorders of the above tissues or cells, particularly of glandular tissues, expression of this gene at significantly higher or lower levels may be routinely detected in certain tissues or cell types (e.g. salivary gland, cancerous and wounded tissues) or bodily fluids (e.g., lymph, serum, chyme, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in salivary glands indicates that the protein product of this gene is useful for the treatment and/or detection of disorders of or injuries to the salivary gland or other glandular tissue. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:109 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 597 of SEQ ID NO:109, b is an integer of 15 to 611, where both a and b correspond to the positions of nucleotide residues shown in SEQ ID NO:109, and where b is greater than or equal to a+14.

Features of Protein Encoded by Gene No: 100

The translation product of this gene shares sequence homology with a *C.elegans* gene. Based upon its degree of conservation, an important cellular function can be attributed to this protein. When tested against Jurkat cell lines, supernatants removed from cells containing this gene activated the GAS (gamma activating sequence) promoter element. Thus, it is likely that this gene activates T-cells through the JAK-STAT signal transduction pathway. GAS is a promoter element found upstream of many genes which are involved in the Jak-STAT pathway. The Jak-STAT pathway is a large, signal transduction pathway involved in the differentiation and proliferation of cells. Therefore, activation of the Jak-STAT pathway, reflected by the binding of the GAS element, can be used to indicate proteins involved in the proliferation and differentiation of cells. In specific embodiments, polypeptides of the invention comprise the sequence: DPRVRLNSLTCKHIFISLTQ (SEQ ID NO:902), TMKLLKLRRNIVKLSLYRHFTN (SEQ ID NO:895), TLILAVAASIVFIWTTMKFRI (SEQ ID NO:896), VTCQSDWRELWVDDAIWRLLFSMILFVI (SEQ ID NO:897), MVLWRPSANNQRFAFSPLSEEEEEDEQ (SEQ ID NO:898), MVLWRPSANNQRFAFSPLSEEEEEDEQ (SEQ ID NO:899), KEPMLKESFEGMKMRSTKQEPNGNSKVNKAQEDDL (SEQ ID NO:900), NAFGRHSTAVK (SEQ ID NO:903), ESCLLCGISEYPIQRXICPGCFDPCRXAFSSETLTGSNPGHHSQSGIWHRQATPGVTLHKVVVAXALYLLFSGMEGVLRVTGAQTDLASLAFIPLAFLDTALCWWIFISL TQTMKLLKLRRNIVKLSLYRHFNTLILAVAASIVFII WTTMKFRIVTCQSDWRELWVDDAIWRLLFSMILFVIM VLWRPSANNQRFAFSPLSEEEEEDEQKEPMLKESFEG MKMRSTKQEPNGNSKVNKAQEDDLKWVEENVPSSVTD VALPALLDSDEERMITHFERSKME (SEQ ID NO:904), and/or KWVEENVPSSVTDVALPALLDSDEERMITHFERSK ME (SEQ ID NO:901). Polynucleotides encoding these polypeptides are also encompassed by the invention. The gene encoding the disclosed cDNA is believed to reside on chromosome 15. Accordingly, polynucleotides related to this invention are useful as a marker in linkage analysis for chromosome 15.

This gene is expressed primarily in thyroid, and to a lesser extent, in osteoclastoma, kidney medulla, and lung.

Therefore, polynucleotides and polypeptides of the invention are useful as reagents for differential identification of the tissue(s) or cell type(s) present in a biological sample and for diagnosis of diseases and conditions which include, but are not limited to, endocrine disorders, particularly thyroid dysfunction or cancer. Similarly, polypeptides and antibodies directed to these polypeptides are useful in providing immunological probes for differential identification of the tissue(s) or cell type(s). For a number of disorders of the above tissues or cells, particularly of the endocrine system, expression of this gene at significantly higher or lower levels may be routinely detected in certain tissues or cell types (e.g., endocrine, skeletal, urogenital, renal, pulmonary, and cancerous and wounded tissues) or bodily fluids (e.g., lymph, pulmonary surfactant or sputum, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 348 as residues: Lys-107 to Leu-124, Glu-150 to Thr-159, Pro-173 to Asp-179, Ser-192 to Ser-201.

The tissue distribution in thyroid, combined with the detected GAS biological activity, indicates that the protein product of this gene is useful for the diagnosis and treatment of thyroid dysfunction or cancer. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:110 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2618 of SEQ ID NO:110, b is an integer of 15 to 2632, where both a and b correspond to the positions of nucleotide residues shown in SEQ ID NO:110, and where b is greater than or equal to a+14.

Features of Protein Encoded by Gene No: 101

The gene encoding the disclosed cDNA is thought to reside on chromosome 16. Accordingly, polynucleotides related to this invention are useful as a marker in linkage analysis for chromosome 16. In specific embodiments, polypeptides of the invention comprise the sequence: YEPMDFXMALIYD (SEQ ID NO:905), IRHELTVLRDTRPACA (SEQ ID NO:906), and/or MDFXMALIYD (SEQ ID NO:907). Polynucleotides encoding these polypeptides are also encompassed by the invention.

This gene is expressed primarily in kidney cortex, and to a lesser extent, in adult brain, corpus colosum, hippocampus, and frontal cortex.

Therefore, polynucleotides and polypeptides of the invention are useful as reagents for differential identification of the tissue(s) or cell type(s) present in a biological sample and for diagnosis of diseases and conditions which include, but are not limited to, neurological disorders, kidney disorders. Similarly, polypeptides and antibodies directed to these polypeptides are useful in providing immunological probes for differential identification of the tissue(s) or cell type(s). For a number of disorders of the above tissues or cells, particularly of the central nervous system and renal system, expression of this gene at significantly higher or lower levels may be routinely detected in certain tissues or cell types (e.g. kidney, brain, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in adult brain, corpus colosum, hippocampus, and frontal cortex indicates that the protein product of this gene is useful for treatment or diagnosis of neurological disorders, such as Alzheimers Disease, Parkinsons Disease, Huntingtons Disease, Tourette Syndrome, schizophrenia, mania, dementia, paranoia, obsessive compulsive disorder, panic disorder, learning disabilities, ALS, psychoses, autism, and altered bahaviors, including disorders in feeding, sleep patterns, balance, and perception. In addition, the gene or gene product may also play a role in the treatment and/or detection of developmental disorders associated with the developing embryo, or sexually-linked disorders. Furthermore, The tissue distribution in kidney indicates that this gene or gene product could be used in the treatment and/or detection of kidney diseases including renal failure, nephritus, renal tubular acidosis, proteinuria, pyuria, edema, pyelonephritis, hydronephritis, nephrotic syndrome, crush syndrome, glomerulonephritis, hematuria, renal colic and kidney stones, in addition to Wilms Tumor Disease, and congenital kidney abnormalities such as horseshoe kidney, polycystic kidney, and Falconi's syndrome. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:111 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a-b, where a is any integer between 1 to 2235 of SEQ ID NO:111, b is an integer of 15 to 2249, where both a and b correspond to the positions of nucleotide residues shown in SEQ ID NO:111, and where b is greater than or equal to a+14.

Features of Protein Encoded by Gene No: 102

The translation product of this gene shares sequence homology with F15C11.2 of *C. elegans* which is of unknown function. In specific embodiments, polypeptides of the invention comprise the sequence:MQEMMRNQDRALSNLESIPGGYNA (SEQ ID NO:908), LRRMYTDIQEPMLSAAQEQFGGNPF (SEQ ID NO:909), ASLVSNTSSGEGSQPSRTENRDPLPNPWAPQT (SEQ ID NO:910), SQSSSASSGTASTVGGTTGSTASGTSGQSTTAPNLVPGVGASMFNTPGMQSLLQQITENPQLMQNMLSAPY (SEQ ID NO:911), MRSMMQSLSQNPDLAAQMMLNNPLFAGNPQLQEQMRQQLPTFLQQ (SEQ ID NO:912), MQNPDTLSAMSNPRAMQALLQIQQGLQTLATEAPGLIPGFTPGLGALGSTGGSSGTNGSNATPSENTSPTAGT (SEQ ID NO:913), TEPGHQQFIQQMLQALAGVNPQLQNPEVRFQQQLEQLSAMGFLNREANLQALIATGGDINAAIERLLGSQPS (SEQ ID NO:914), RNPAMMQEMMRNQDRALSNLESIPGGYNALRRMYTDIQEPMLSAA (SEQ ID NO:915), GNPFASLVSNTSS (SEQ ID NO:916), ENRDPLPNPWA (SEQ ID NO:917), GKILKDQDTLSQHGIHD (SEQ ID NO:918), GLTVHLVIKTQNRP (SEQ ID NO:919), SELQSQMQRQLLSNPEMM (SEQ ID NO:920), PEISHMLNNPDIMR (SEQ ID NO:921), and/or RQLIMANPQMQQLIQRNP (SEQ ID NO:922). Polynucleotides encoding these polypeptides are also encompassed by the invention.

This gene is expressed primarily in breast.

Therefore, polynucleotides and polypeptides of the invention are useful as reagents for differential identification of the tissue(s) or cell type(s) present in a biological sample and for diagnosis of diseases and conditions which include, but are not limited to, breast cancer. Similarly, polypeptides and antibodies directed to these polypeptides are useful in providing immunological probes for differential identification of the tissue(s) or cell type(s). For a number of disorders of the above tissues or cells, particularly of tumor systems, expression of this gene at significantly higher or lower levels may be routinely detected in certain tissues or cell types (e.g. breast, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in breast indicates that the protein product of this gene is useful for treatment and diagnosis of some types of breast cancer. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:112 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a-b, where a is any integer between 1 to 2184 of SEQ ID NO:112, b is an integer of 15 to 2198, where both a and b correspond to the positions of nucleotide residues shown in SEQ ID NO:112, and where b is greater than or equal to a+14.

Features of Protein Encoded by Gene No: 103

The translation product of this gene shares sequence homology with secreted serine proteases and lysozyme C precursor, which is thought to be important in bacteriolytic function. In specific embodiments, polypeptides of the invention comprise the sequene: NLCHVDCQDLLNPN-LLAGIHCAKRIVS (SEQ ID NO:923), LDGFEGYSLSD-WLCLAFVESKFN (SEQ ID NO:924), NENADGS-FDYGLFQINSHYWCN (SEQ ID NO:925), NLCHVDCQDLLNPNLLAGIHCAKRIVS (SEQ ID NO:926), and/or EPSALSCTSSPPR (SEQ ID NO:927). Polynucleotides encoding these polypeptides are also encompassed by the invention.

This gene is expressed primarily in testes.

Therefore, polynucleotides and polypeptides of the invention are useful as reagents for differential identification of the tissue(s) or cell type(s) present in a biological sample and for diagnosis of diseases and conditions which include, but are not limited to, infection, immune system disorders, reproductive disorders. Similarly, polypeptides and antibodies directed to these polypeptides are useful in providing immunological probes for differential identification of the tissue(s) or cell type(s). For a number of disorders of the above tissues or cells, particularly of the immune system and reproductive system, expression of this gene at significantly higher or lower levels may be routinely detected in certain tissues or cell types (e.g. testes, cancerous and wounded tissues) or bodily fluids (e.g., lymph, serum, seminal fluid, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 351 as residues: Ile-62 to Phe-70, Asn-78 to Asn-84.

The tissue distribution in testes, combined with the homology to lysozyme C precursor indicates that the protein product of this gene is useful for boosting the monocyte-macrophage system, and for enhancing the activity of immunoagents. Alternatively, the tissue distribution indicates that the protein product of this gene is useful for the treatment and diagnosis of conditions concerning proper testicular function (e.g. endocrine function, sperm maturation), as well as cancer. Therefore, this gene product is useful in the treatment of male infertility and/or impotence. This gene product is also useful in assays designed to identify binding agents, as such agents (antagonists) are useful as male contraceptive agents. Similarly, the protein is believed to be useful in the treatment and/or diagnosis of testicular cancer. The testes are also a site of active gene expression of transcripts that may be expressed, particularly at low levels, in other tissues of the body. Therefore, this gene product may be expressed in other specific tissues or organs where it may play related functional roles in other processes, such as hematopoiesis, inflammation, bone formation, and kidney function, to name a few possible target indications.

Many polynucleotide sequences, such as EST sequences, are publicly available and accessible through sequence databases. Some of these sequences are related to SEQ ID NO:113 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1029 of SEQ ID NO:113, b is an integer of 15 to 1043, where both a and b correspond to the positions of nucleotide residues shown in SEQ ID NO:113, and where b is greater than or equal to a+14.

Features of Protein Encoded by Gene No: 104

This gene is expressed primarily in apoptotic T-cell, and to a lesser extent in CD34(+) cells.

Therefore, polynucleotides and polypeptides of the invention are useful as reagents for differential identification of the tissue(s) or cell type(s) present in a biological sample and for diagnosis of diseases and conditions which include, but are not limited to, immune disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in T-cells indicates that the protein product of this gene is useful for treatment and diagnosis of some immune disorders. Furthermore, this gene product may be involved in the regulation of cytokine production, antigen presentation, or other processes that may also suggest a usefulness in the treatment of cancer (e.g. by boosting immune responses). Since the gene is expressed in cells of lymphoid origin, the gene or protein, as well as, antibodies directed against the protein may show utility as a tumor marker and/or immunotherapy targets for the above listed tissues. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. Expression of this gene product in T cells also strongly indicates a role for this protein in immune function and immune surveillance. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:114 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 689 of SEQ ID NO:114, b is an integer of 15 to 703, where both a and b correspond to the positions of nucleotide residues shown in SEQ ID NO:114, and where b is greater than or equal to a+14.

Features of Protein Encoded by Gene No: 105

The translation product of this gene shares sequence homology with ARI protein of Drosophila (See Genbank Accession 2058299; EMBL: locus DMARIADNE, accession X98309), which is thought to be important in axonal path-finding in the central nervous system. In specific embodiments, polypeptides of the invention comprise the sequence IREVNEVIQNPAT (SEQ ID NO:928), ITRILLSHFNWDKEKLMERYFDGNLEKLFA (SEQ ID NO:929), NTRSSAQDMPCQICYLNYPNSYF (SEQ ID NO:930), TGL ECGHKFCMQCWSEYLTTKIMEEG-MGQTISCPAHG (SEQ ID NO:936), CDILV DDNTVMR-LITDSKVKLKYQHLITNSFVECNRLLK-WCPAPDCHHVVKVQYPDAKPV (SEQ ID NO:931), CDILVDDNTVMRLITDSKVKLKYQHLIT-NSFVECNRLLKWCPAPDCHHVVKV (SEQ ID NO:932), GCNHMVCRNQNCKAEFCWVCLG PWEPHGSAW-YNCNRYNEDDAKAARDAQERSRAALQRYL (SEQ ID NO:933), FYCNRYMNHMQSLRFEHKLYAQVKQK-MEEMQQHNMSWIEVQFLKKAVDVLCQCRATLMYT (SEQ ID NO:934), and/or YVFAFYLKKNNQSIIFEN-NQADLENATEVLSGYLERDISQD-SLQDIKQKVQDKYRYCESR (SEQ ID NO:935) Polynucleotides encoding these polypeptides are also encompassed by the invention.

This gene is expressed primarily in adult brain, and to a lesser extent in testes, endometrial tumor, melanocytes, and infant brain.

Therefore, polynucleotides and polypeptides of the invention are useful as reagents for differential identification of the tissue(s) or cell type(s) present in a biological sample and for diagnosis of diseases and conditions which include, but are not limited to, diseases or injuries involving axonal path development. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues or cell types (e.g. brain, testes, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in adult brain, combined with the homology to ARI protein indicates that the protein product of this gene is useful for the treatment of disease states or injuries involving axonal path development, including neurodegenerative diseases and nerve injury, such as Alzheimers Disease, Parkinsons Disease, Huntingtons Disease, Tourette Syndrome, schizophrenia, mania, dementia, paranoia, obsessive compulsive disorder, panic disorder, learning disabilities, ALS, psychoses, autism, and altered bahaviors, including disorders in feeding, sleep patterns, balance, and perception. In addition, the gene or gene product may also play a role in the treatment and/or detection of developmental disorders associated with the developing embryo, or sexually-linked disorders. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:115 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 3670 of SEQ ID NO:115, b is an integer of 15 to 3684, where both a and b correspond to the positions of nucleotide residues shown in SEQ ID NO:115, and where b is greater than or equal to a+14.

Features of Protein Encoded by Gene No: 106

The translation product of this gene shares sequence homology with cytochrome b561 [Sus scrofa] which is thought to be an integral membrane protein of neuroendocrine storage vesicles of neurotransmitters and peptide hormones. The gene encoding the disclosed cDNA is thought to reside on chromosome 11. Accordingly, polynucleotides related to this invention are useful as a marker in linkage analysis for chromosome 11.

This gene is expressed primarily in frontal cortex, and to a lesser extent in rhabdomyosarcoma.

Therefore, polynucleotides and polypeptides of the invention are useful as reagents for differential identification of the tissue(s) or cell type(s) present in a biological sample and for diagnosis of diseases and conditions which include, but are not limited to, neurological disorders. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues or cell types (e.g. brain, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 354 as residues: Ser-18 to Pro-24.

The tissue distribution in frontal cortex, combined with the homology to cytochrome b561 [Sus scrofa] indicates that the protein product of this gene is useful for the treatment and diagnosis of neurological disorders. This gene may also be important in the regulation of some types of cancers. Furthermore, the tissue distribution indicates that the protein product of this gene is useful for the diagnosis and/or treatment of disorders of the brain and nervous system. Elevated expression of this gene product within the frontal cortex of the brain indicates that it may be involved in neuronal survival; synapse formation; conductance; neural differentiation, etc. Such involvement may impact many processes, such as learning and cognition. It may also be useful in the treatment of such neurodegenerative disorders as schizophrenia; ALS; or Alzheimer's.

Many polynucleotide sequences, such as EST sequences, are publicly available and accessible through sequence databases. Some of these sequences are related to SEQ ID NO:116 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1951 of SEQ ID NO:116, b is an integer of 15 to 1965, where both a and b correspond to the positions of nucleotide residues shown in SEQ ID NO:116, and where b is greater than or equal to a+14.

Features of Protein Encoded by Gene No: 107

In specific embodiments, polypeptides of the invention comprise the sequence: MWGYLFVDAAWNFLG-CLICGW (SEQ ID NO:937), MHFISSGNVSAIRSSILLL-RXSLSYLGNCLRVSAIFVYFLLFLLLS (SEQ ID NO:938), and/or MDQALRGSPSEGFSTDPSPPQVGR-QIPSFPPWRRLVLPKASGCFLEREWWL-CVFKLRTRPGAEAHAYNSSILGGRGKGIT (SEQ ID NO:939). Polynucleotides encoding these polypeptides are also encompassed by the invention.

This gene is expressed primarily in pancreas tumor, and to a lesser extent in cerebellum.

Therefore, polynucleotides and polypeptides of the invention are useful as reagents for differential identification of the tissue(s) or cell type(s) present in a biological sample and for diagnosis of diseases and conditions which include, but are not limited to, pancreatic tumors. Similarly, polypeptides and antibodies directed to these polypeptides are useful in providing immunological probes for differential identification of the tissue(s) or cell type(s). For a number of disorders of the above tissues or cells, particularly of the endocrine system, expression of this gene at significantly higher or lower levels may be routinely detected in certain tissues or cell types (e.g. pancreas, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 355 as residues: Pro-22 to Phe-33.

The tissue distribution in pancreas tumors indicates that the protein product of this gene is useful for diagnosis and treatment of pancreatic tumors, and/or tumors of metabolic tissues and cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:117 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 489 of SEQ ID NO:117, b is an integer of 15 to 503, where both a and b correspond to the positions of nucleotide residues shown in SEQ ID NO:117, and where b is greater than or equal to a+14.

Features of Protein Encoded by Gene No: 108

The gene encoding the disclosed cDNA is thought to reside on chromosome 17. Accordingly, polynucleotides related to this invention are useful as a marker in linkage analysis for chromosome 17. In specific emobodiments, polypeptides of the invention comprise the sequence: MLPALASCCHFSPPEQAAR-LKKLQEQEKQQKVEFRKRMEKEVSD-FIQDSGQIKKKFQPMNKIERSILHD-VVEVAGLTSFSFGEDDDCRYVMIFKKEFAPSDEELD SYRRGEEWDPQKAEEKRNXKELAQRQ (SEQ ID NO:940), EEEAAQQGPVVVSPASDYKDKYSHLIGK-GAAKDAAHMLQANKTYGCXP-VANKRDTRSIEEAMNEIRAKKRLRQSGE (SEQ ID NO:941), PPRRPAQLPLTPGAGQGAGRDKAAAIR-AHPGAPPLNHLLP (SEQ ID NO:942), AVPQAG-GKQVFDLSPLELGYVRGMCVCV (SEQ ID NO:943) and/or MLPALASCCHFSPPEQAAR-LKKLQEQEKQQKVEFRK RMEKEVSDFIQDSG-QIKKKFQPMNKIERSILHDVVEVAGLTS-FSFGEDDDCRYVMILFKKEFAPSDEELDSYRRGEEW DPQKAEEKRNXKELAQRQEEEAAQQGPV-VVSPASDY KDKYSHLIGKGAAKDAAHMLQANK-TYGCXPVANKRD TRSIEEAMNEIRAKKRLRQSGE (SEQ ID NO:944). Polynucleotides encoding these polypeptides are also encompassed by the invention. The translation product of this gene shares sequence homology with FSA-1, which may play a role as a structural protein component of the acrosome. The mammalian spermatozoon undergoes continuous modifications during spermatogenesis, maturation in the epididymis, and capacitation in the female reproductive tract. Only the capacitated spermatozoa are capable of binding the zona-intact egg and undergoing the acrosome reaction. The fertilization process is a net result of multiple molecular events which enable ejaculated spermatozoa to recognize and bind to the egg's extracellular coat, the zona pellucida (ZP). Sperm-egg interaction is a species-specific event which is initiated by the recognition and binding of complementary molecule(s) present on sperm plasma membrane (receptor) and the surface of the ZP (ligand). This is a carbohydrate-mediated event which initiates a signal transduction cascade resulting in the exocytosis of acrosomal contents. This step is believed to be a prerequisite which enables the acrosome reacted spermatozoa to penetrate the ZP and fertilize the egg. Recently, another group published this gene, calling it sperm acrosomal protein [Homo sapiens] (Proc. Natl. Acad. Sci. U.S.A. 95 (14), 8175–8180 (1998)).

This gene is expressed primarily in fetal kidney and sperm.

Therefore, polynucleotides and polypeptides of the invention are useful as reagents for differential identification of the tissue(s) or cell type(s) present in a biological sample and for diagnosis of diseases and conditions which include, but are not limited to, male reproductive disorders, especially involving acrosomal disfunction. Similarly, polypeptides and antibodies directed to these polypeptides are useful in providing immunological probes for differential identification of the tissue(s) or cell type(s). For a number of disorders of the above tissues or cells, particularly of the male reproductive system, expression of this gene at significantly higher or lower levels may be routinely detected in certain tissues or cell types (e.g. sperm, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 356 as residues: Met-12 to Gln-30, Lys-35 to Val-46, Arg-49 to Val-56, Gln-61 to Glu-77, Gly-96 to Cys-101, Glu-110 to Lys-139, Leu-141 to Gln-151, Ser-161 to Tyr-167, Asn-196 to Ile-203, Arg-211 to Ser-227.

The tissue distribution in sperm, combined with the homology to FSA-1 and the Homo sapiens sperm acrosomal protein indicates that the protein product of this gene is useful for the treatment of infertility due to acrosomal disfunction of sperm. Protein may also be useful as a contraceptive either alone, or in combination with other therapies. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:118 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1057 of SEQ ID NO:118, b is an integer of 15 to 1071, where both a and b correspond to the positions of nucleotide residues shown in SEQ ID NO:118, and where b is greater than or equal to a+14.

Features of Protein Encoded by Gene No: 109

This gene is expressed primarily in pituitary tissue, and to a lesser extent in epididymus.

Therefore, polynucleotides and polypeptides of the invention are useful as reagents for differential identification of the tissue(s) or cell type(s) present in a biological sample and for diagnosis of diseases and conditions which include, but are not limited to, male reproductive disorders. Similarly, polypeptides and antibodies directed to these polypeptides are useful in providing immunological probes for differential identification of the tissue(s) or cell type(s). For a number of disorders of the above tissues or cells, particularly of the male reproductive system, expression of this gene at significantly higher or lower levels may be routinely detected in certain tissues or cell types (e.g. epididymus, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 357 as residues: Met-1 to Trp-6.

Because the gene is found in both pituitary and epididymus, this indicates that the protein product of this gene is useful for the treatment and diagnosis of male reproductive disorders. This may involve a secreted peptide produced in the pituitary targeting the epididymus. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:119 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1087 of SEQ ID NO:119, b is an integer of 15 to 1101, where both a and b correspond to the positions of nucleotide residues shown in SEQ ID NO:119, and where b is greater than or equal to a+14.

Features of Protein Encoded by Gene No: 110

In specific embodiments, polpeptides of the invention comprise the sequence:LLCPVLNSGXSWNF-PHPSQPEYSFHGFHSTRLWI (SEQ ID NO:945), and/or PSTPWFLFLLGLTCPFSTSHPRWDSIPP (SEQ ID NO:946). Polynucleotides encoding these polypeptides are also encompassed by the invention.

This gene is expressed primarily in resting T-cells.

Therefore, polynucleotides and polypeptides of the invention are useful as reagents for differential identification of the tissue(s) or cell type(s) present in a biological sample and for diagnosis of diseases and conditions which include, but are not limited to, T-cell disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in T-cells indicates that the protein product of this gene is useful for the treatment and diagnosis of certain immune disorders, especially those involving T-cells. Furthermore, this gene product may be involved in the regulation of cytokine production, antigen presentation, or other processes that may also suggest a usefulness in the treatment of cancer (e.g. by boosting immune responses). Since the gene is expressed in cells of lymphoid origin, the gene or protein, as well as, antibodies directed against the protein may show utility as a tumor marker and/or immunotherapy targets for the above listed tissues. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. Expression of this gene product in T cells also strongly indicates a role for this protein in immune function and immune surveillance. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:120 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 268 of SEQ ID NO:120, b is an integer of 15 to 282, where both a and b correspond to the positions of nucleotide residues shown in SEQ ID NO:120, and where b is greater than or equal to a+14.

Features of Protein Encoded by Gene No: 111

The gene encoding the disclosed cDNA is thought to reside on chromosome 10. Accordingly, polynucleotides related to this invention are useful as a marker in linkage analysis for chromosome 10.

This gene is expressed primarily in cerebellum and whole brain, and to a lesser extent in infant brain and fetal kidney.

Therefore, polynucleotides and polypeptides of the invention are useful as reagents for differential identification of the tissue(s) or cell type(s) present in a biological sample and for diagnosis of diseases and conditions which include, but are not limited to, neurological disorders. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues or cell types (e.g. brain, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 359 as residues: Asp-48 to Gly-55.

The tissue distribution in cerebellum and whole brain indicates that the protein product of this gene is useful for diagnosis and treatment of neurological disorders, such as Alzheimers Disease, Parkinsons Disease, Huntingtons Disease, Tourette Syndrome, schizophrenia, mania, dementia, paranoia, obsessive compulsive disorder, panic disorder, learning disabilities, ALS, psychoses, autism, and altered bahaviors, including disorders in feeding, sleep patterns, balance, and perception. In addition, the gene or gene product may also play a role in the treatment and/or detection of developmental disorders associated with the developing embryo, or sexually-linked disorders. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:121 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2621 of SEQ ID NO:121, b is an integer of 15 to 2635, where both a and b correspond to the positions of nucleotide residues shown in SEQ ID NO:121, and where b is greater than or equal to a+14.

Features of Protein Encoded by Gene No: 112

The translation product of this gene shares sequence homology with yeast mitochondrial ribosomal protein, which is homologous to ribosomal protein s15 of E.coli, which is thought to be important in the early assembly of ribosomes (See Genbank Accession No. M38016). The gene encoding the disclosed cDNA is thought to reside on chromosome 1. Accordingly, polynucleotides related to this invention are useful as a marker in linkage analysis for chromosome 1.

This gene is expressed primarily in developmental tissues.

Therefore, polynucleotides and polypeptides of the invention are useful as reagents for differential identification of the tissue(s) or cell type(s) present in a biological sample and for diagnosis of diseases and conditions which include, but are not limited to, development of cancers and tumors in addition to healing wounds. Similarly, polypeptides and antibodies directed to these polypeptides are useful in providing immunological probes for differential identification of the tissue(s) or cell type(s). For a number of disorders of the above tissues or cells, particularly of the immune and developmental systems, expression of this gene at significantly higher or lower levels may be routinely detected in certain tissues or cell types (e.g. developmental, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in developmental tissues, combined with the homology to ribosomal protein s15 of E. coli indicates that the protein product of this gene is useful for the diagnosis and/or treatment of diseases related to the assembly of ribosomes in the mitochondria, which is important in the translation of RNA into protein. Therefore, this indicates that the protein product of this gene is also useful for the diagnosis and intervention of multiple tumors, as well as in healing wounds, which are thought to be under similar regulation as developmental tissues. Protein, as well as, antibodies directed against the protein have utility as tumor markers, in addition to immunotherapy targets, for the above listed tumors and tissues.

Many polynucleotide sequences, such as EST sequences, are publicly available and accessible through sequence databases. Some of these sequences are related to SEQ ID NO:122 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b where a is any integer between 1 to 980 of SEQ ID NO:122, b is an integer of 15 to 994, where both a and b correspond to the positions of nucleotide residues shown in SEQ ID NO:122, and where b is greater than or equal to a+14.

Features of Protein Encoded by Gene No: 113

The translation product of this gene shares sequence homology with human poliovirus receptor precursors which are thought to be important in viral binding and uptake. The translation product of this gene also shares homology with a mouse member of the immunosuperfamily, which is thought to be important in proper immune function (GENBANK: accession AF061260). Preferred polypeptide fragments comprise the following amino acid sequence: ELSISISNVALADEGEYTCSIFTMPVR-TAKSLVTVLGIPQKPIITGYKSSLREKD-TATLNCQSSGSKPAARLTWRKGDQELH-GEPTRIQEDPNGKTFTVSSSVTFQVTREDDGASIVCS VNHESLKGADRSTSQRIEVLYIPTAMIRPDPPHPREG QKLLLHCEGRGNPVPQQYLWEKEGSVP-PLKMTQESAL IFPFLNKSDSGTYGCTATSNMG-SYKAYYTLNVND (SEQ ID NO:947), ELSISISNV-ALADEGEYTCSIFTMPVRTAKSLVTVLGIPQKPIITG YKSSLREKDTATLNCQSS (SEQ ID NO:948), CQSSG-SKPAARLTWRKGDQELHGEPTRIQEDP-NGKTFTVSSSVTFQVTREDDGASIVCSVNHESL (SEQ ID NO:949), HESLKGADRSTSQRIEVLYTPTAMIRPD- PPHPREGQKLLLHCEGRGNPVPQQYLWEKE (SEQ ID NO:950), WEKEGSVPPLKMTQESALIFPFLNKSDSGTYGCTATSNMGSYKAYYTLNVND (SEQ ID NO:951), PSPVPSSSSTYHAIIGGIVAFIVFLLLIMLIFLGHY (SEQ ID NO:952), and/or LIRHKGTYLTHEAKGSDDAPDADTAIINAEGGQSGGDDKKEYFI (SEQ ID NO:953). Also preferred are polynucleotide fragments encoding these polypeptide fragments. The gene encoding the disclosed cDNA is thought to reside on chromosome 1. Accordingly, polynucleotides related to this invention are useful as a marker in linkage analysis for chromosome 1.

This gene is expressed almost exclusively in human brain tissue.

Therefore, polynucleotides and polypeptides of the invention are useful as reagents for differential identification of the tissue(s) or cell type(s) present in a biological sample and for diagnosis of diseases and conditions which include, but are not limited to, suceptibility to viral disease and diseases of the CNS, especially cancers of that system. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues or cell types (e.g. brain, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 361 as residues: Leu-26 to Asp-37, Lys-53 to Ser-59.

The tissue distribution in brain, combined with the homology to poliovirus receptor precursors indicates that the protein product of this gene is useful for the treatment and prevention of diseases that involve the binding and uptake of virus particles for infection. It is also helpful in genetic therapy where the goal is to insert foreign DNA into infected cells. With the help of this protein, the binding and uptake of this foreign DNA might be aided. In addition, it is expected that over expression of this gene will indicate abnormalities involving the CNS, particularly cancers of that system. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:123 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1528 of SEQ ID NO:123, b is an integer of 15 to 1542, where both a and b correspond to the positions of nucleotide residues shown in SEQ ID NO:123, and where b is greater than or equal to a+14.

Features of Protein Encoded by Gene No: 114

The translation product of this gene shares sequence homology with YO87_CAEEL hypothetical 28.5 KD protein ZK1236.7 in chromosome III of *Caenorhabditis elegans* in addition to alpha-1 collagen type III (See Genbank Accession No. gi|537432). One embodiment for this gene is the polypeptide fragment(s) comprising the following amino acid sequence: VPELPDRVHQLHQAVQGCALGRPGFPGGPTHSGHHKSHPGPAGGDYNRCDRPGQVHLHNPRGTGRRGQLHPTAGPGVHRRACPSQQLPHRLGPGVPCPSPSLTPVLPSWTQSWCGLPGYTSSS (SEQ ID NO:954), VHQLHQAVQGCALGRPGFPGGP (SEQ ID NO:955), PTHSGHHKSHPGPAGGDYNRCDRPGQVHLHNPRGTGRRGQLH (SEQ ID NO:956), and/or LHPTAGPGVHRRACPSQQLPHRLGPGVPCPSPSLTPVLPSWTQSWCGLPGYTSSS (SEQ ID NO:957). An additional embodiment is the polynucleotide fragment(s) encoding these polypeptide fragments.

This gene is expressed primarily in brain cells, and to a lesser extent in activated B and T cells.

Therefore, polynucleotides and polypeptides of the invention are useful as reagents for differential identification of the tissue(-s) or cell type(s) present in a biological sample and for diagnosis of diseases and conditions which include, but are not limited to, neurodegeneration and immunological disorders. Similarly, polypeptides and antibodies directed to these polypeptides are useful in providing immunological probes for differential identification of the tissue(s) or cell type(s). For a number of disorders of the above tissues or cells, particularly of the neural and immune systems, expression of this gene at significantly higher or lower levels may be routinely detected in certain tissues or cell types (e.g. brain, immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 362 as residues: Glu-34 to Glu-39, Gly-51 to Ser-72, Ala-88 to Glu-93, Gln-100 to Val-105.

The tissue distribution in brain cells, combined with the homology to YO87_CAEEL hypothetical 28.5 KD protein ZK1236.7 in chromosome III of *Caenorhabditis elegans* as well as to a conserved alpha-1 collagen type III protein indicates that the protein product of this gene is useful for the detection and treatment of neurodegenerative disease states and behavioral disorders such as Alzheimer's Disease, Parkinson's Disease, Huntington's Disease, schizophrenia, mania, dementia, paranoia, obsessive compulsive disorder and panic disorders. Because the gene is expressed in cells of lymphoid origin, the natural gene product may be involved in immune functions. Therefore it may be also used as an agent for immunological disorders including arthritis, asthma, immune deficiency diseases such as AIDS, and leukemia. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:124 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1376 of SEQ ID NO:124, b is an integer of 15 to 1390, where both a and b correspond to the positions of nucleotide residues shown in SEQ ID NO:124, and where b is greater than or equal to a+14.

Features of Protein Encoded by Gene No: 115

The translation product of this gene shares sequence homology with alpha 3 type IX collagen, which is thought to be important in hyaline cartilage formation via its ability to uptake inorganic sulfate by cells (See Genbank Accession No. gi|975657). One embodiment of this gene is the polypeptide fragment comprising the following amino acid sequence: SLRRPRSAAXQTLTTFLSSVSSASSSAL-PGSREPCDPRAPPPPRSGSAASCCSC-CCSCPRRRAPLRSPRGSKRRIRQREVVD-LYNGMCLQGPAGVPGRDGSPGANGIPGTPGIPGRD GFKGEKGECLRESFEESWTPNYKQC-SWSSLNYGIDLGKIAECTFTKMRSNSAL-RVLFSGSLRLKCRNACCQRWYFTFN-GAECSGPLPIEAIIYLDQGSPEMNSTINIHRTSSVEGL CEGIGAGLVDVAIWVGTCSDYPKGDAST-GWNSVSRIII EELPK (SEQ ID NO:958), SLRRPRSAAX-QTLTTFLSSVSSASSSALPGSREPCD-PRAPPPPRSGSAASCCSCCCSCPRR (SEQ ID NO:959), RAPLRSPRGSKRRIRQREVVDLYNGM-CLQGPAGVPGRDGSPGANGIPGTPGI (SEQ ID NO:960), TPGIPGRDGFKGEKGECLRESFEESWTP-NYKQCSWSSLNYGIDLGKIAECTF (SEQ ID NO:961), FTKMRSNSALRVLFSGSLRLKCRNAC-CQRWYFTFNGAECSGPLPIEAIIYLDQG-SPEMNSTINIHR (SEQ ID NO:962), and/or RTSSVEG-LCEGIGAGLVDVAIWVGTCSDYPKGDASTGWNSVS RIIIEELPK (SEQ ID NO:963). An additional embodiment are the polynucleotide fragments encoding these polypeptide fragments.

This gene is expressed primarily in smooth muscle, and to a lesser extent in synovial tissue.

Therefore, polynucleotides and polypeptides of the invention are useful as reagents for differential identification of the tissue(s) or cell type(s) present in a biological sample and for diagnosis of diseases and conditions which include, but are not limited to, dwarfism, spinal deformation, and specific joint abnormalities as well as chondrodysplasias ie. spondyloepiphyseal dysplasia congenita, familial osteoarthritis, Atelosteogenesis type II, metaphyseal chondrodysplasia type Schmid and autoimmune disorders. Similarly, polypeptides and antibodies directed to these polypeptides are useful in providing immunological probes for differential identification of the tissue(s) or cell type(s). For a number of disorders of the above tissues or cells, particularly of the skeletal system, expression of this gene at significantly higher or lower levels may be routinely detected in certain tissues or cell types (e.g. muscle, synovial tissues, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in smooth muscle, and homology to alpha 3 type IX collagen indicates that the protein product of this gene is useful for the treatment and diagnosis of diseases associated with the mutation in this gene which leads to the many different types of chondrodysplasias. By the use of this product, the abnormal growth and development of bones of the limbs and spine could be detected or treated in utero, since the protein or muteins thereof could affect epithelial cells early in development, and later the chondrocytes of the developing craniofacial structure. In addition, the expression of this gene product in synovium would suggest a role in the detection and treatment of disorders and conditions affecting the skeletal system, in particular osteoporosis as well as disorders afflicting connective tissues (e.g. arthritis, trauma, tendonitis, chrondomalacia and inflammation), such as in the diagnosis or treatment of various autoimmune disorders such as rheumatoid arthritis, lupus, scleroderma, and dermatomyositis as well as dwarfism, spinal deformation, and specific joint abnormalities as well as chondrodysplasias (ie. spondyloepiphyseal dysplasia congenita, familial osteoarthritis, Atelosteogenesis type II, metaphyseal chondrodysplasia type Schmid). Moreover, the expression within smooth muscle indicates t that polynucleotides and polypeptides corresponding to this gene are useful for the treatment, detection, and/or prevention of a variety of vascular disorders, which include, but are not limited to, atherosclerosis, embolism, stroke, aneurysm, or miscrovascular disease. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:125 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1274 of SEQ ID NO:125, b is an integer of 15 to 1288, where both a and b correspond to the positions of nucleotide residues shown in SEQ ID NO:125, and where b is greater than or equal to a+14.

Features of Protein Encoded by Gene No: 116

The translation product of this gene shares sequence homology with retrovirus-related reverse transcriptase, which is thought to be important in viral replication. Preferred polypeptide fragments comprising the following amino acid sequence: TKKENCRPASLMNIDT-KILNKILMNQ (SEQ ID NO:964). An additional embodiment is the polynucleotide fragments encoding this polypeptide fragment (See Genbank Accession No. pir|A25313|GNHUL1).

This gene is expressed primarily in human meningima.

Therefore, polynucleotides and polypeptides of the invention are useful as reagents for differential identification of the tissue(s) or cell type(s) present in a biological sample and for diagnosis of diseases and conditions which include, but are not limited to, retroviral diseases such as AIDS, and possibly certain cancers due to transactivation of latent cell division genes. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. meningima, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in human meningima, combined with the homology to a retrovirus-related reverse transcriptase indicates that the protein product of this gene is useful for the detection and treatment of diseases and conditions associated with retroviral infection, since a functional reverse transcriptase (RT) or RT-like molecule is an integral component of the retroviral life cycle. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:126 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1503 of SEQ ID NO:126, b is an integer of 15 to 1517, where both a and b correspond to the positions of nucleotide residues shown in SEQ ID NO:126, and where b is greater than or equal to a+14.

Features of Protein Encoded by Gene No: 117

The translation product of this gene shares sequence homology with an unknown gene from *C. elegans*, as well as weak homolog with mammalian metaxin, a gene contiguous to both thrombospondin 3 and glucocerebrosidase, and is known to be required for embryonic development. Recently another group gened and sequenced this gene from humans, naming it metaxin 2. It is thought that metaxin 1 and metaxin 2 interact, and are associated with the mammalian mitochondrial outer membrane (See Genbank Accession No. AF053551). Preferred polypeptide fragments comprise the following amino acid sequence: MCNLPIKVVCRANAEYMSPSGKVPXXH-VGNQVVSELGPIVQFVKAKGHSLSDG-LEEVQKAEMKAYMELVNNMLLTAE-LYLQWCDEATVGXITHXRYGSPYPWPLXHILAYQK QWEVKRKXKAIGWGKKTLDQVLEDVDQC-CQALSQR LGTQPYFFNKQPTELDALVFGHLYTILT-TQLTNDE LSEKVKNYSNLLAFCRRIEQHY-FEDRGKGRLS (SEQ ID NO:965), MCNLPIKVVCRANAEYMSPSGKVPXXH-VGNQVVSELGPIVQFVK (SEQ ID NO:966), FVKAKGHSLSDGLEEVQ-KAEMKAYMELVNNMLLTAELYLQWCDE (SEQ ID NO:967), LQWCDEATVGXITHXRYGSPYPWPLX-HILAYQKQWEVKRKXKAIGWGKKTL (SEQ ID NO:968), DQVLEDVDQCCQALSQRLGTQPY-FFNKQPTELDALVFGHLYTI (SEQ ID NO:969), and/or LTTQLTNDELSEKVKNYSNLLAFCR-RIEQHYFEDRGKGRLS (SEQ ID NO:970). Also preferred are the polynucleotide fragments encoding these polypeptide fragments (See Genbank Accession No. gi|1326108). The gene encoding the disclosed cDNA is thought to reside on chromosome 2. Accordingly, polynucleotides related to this invention are useful as a marker in linkage analysis for chromosome 2.

This gene is expressed primarily in fetal tissues, and to a lesser extent in hematopoietic cells and tissues, including spleen, monocytes, and T cells.

Therefore, polynucleotides and polypeptides of the invention are useful as reagents for differential identification of the tissue(s) or cell type(s) present in a biological sample and for diagnosis of diseases and conditions which include, but are not limited to, cancer; lymphoproliferative disorders; inflammation; chondrosarcoma, and Gaucher disease. Similarly, polypeptides and antibodies directed to these polypeptides are useful in providing immunological probes for differential identification of the tissue(s) or cell type(s). For a number of disorders of the above tissues or cells, particularly of the hematopoietic and embryonic systems, expression of this gene at significantly higher or lower levels may be routinely detected in certain tissues or cell types (e.g. immune, fetal, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in fetal tissues indicates that the protein product of this gene is useful for the diagnosis and treatment of cancer and other proliferative disorders. Moreover, this protein may play a role in the regulation of cellular division. Additionally, the expression in hematopoietic cells and tissues indicates that this protein may play a role in the proliferation, differentiation, and survival of hematopoietic cell lineages. Thus, this gene may be useful in the treatment of lymphoproliferative disorders, and in the maintenance and differentiation of various hematopoietic lineages from early hematopoietic stem and committed progenitor cells. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:127 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1059 of SEQ ID NO:127, b is an integer of 15 to 1073, where both a and b correspond to the positions of nucleotide residues shown in SEQ ID NO:127, and where b is greater than or equal to a+14.

Features of Protein Encoded by Gene No: 118

The translation product of this gene shares sequence homology with reverse transcriptase, which is important in the synthesis of a cDNA chain from an RNA molecule, and is a method whereby the infecting RNA chains of retroviruses are transcribed into their DNA complements. Specific embodiments for this gene are the polypeptide fragments comprising the following amino acid sequences: MXXXN-SHITIFTLNVNGLNAPNERHRLAN-WIQSQDQVCCIQETHLTGRDTHRLKIKG-WRKIYQANGKQKK (SEQ ID NO:971), FTLNVNGLNAPNERHRLANWIQSQDQVC (SEQ ID NO:972), THLTGRDTHRLKIKGWR (SEQ ID NO:973), and/or GWRKIYQANGKQKK (SEQ ID NO:974). Additional embodiments are the polynucleotide fragments comprising polynucleotides encoding these polypeptide fragments (See Genbank Accession No. gi|2072964).

This gene is expressed primarily in skin, and to a lesser extent in neutrophils.

Therefore, polynucleotides and polypeptides of the invention are useful as reagents for differential identification of the tissue(s) or cell type(s) present in a biological sample and for diagnosis of diseases and conditions which include, but are not limited to, cancers; hematopoietic disorders; inflammation; disorders of immune surveillance. Similarly, polypeptides and antibodies directed to these polypeptides are useful in providing immunological probes for differential identification of the tissue(s) or cell type(s). For a number of disorders of the above tissues or cells, particularly of the epidermis and/or hematopoietic system, expression of this gene at significantly higher or lower levels may be routinely detected in certain tissues or cell types (e.g. skin, immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in skin, combined with the homology to a reverse transcriptase indicates that the protein product of this gene is useful for cancer therapy, particularly of the integumentary system. Expression in the skin also indicates that this gene is useful in wound healing and fibrosis. Expression by neutrophils also indicates that this gene product plays a role in inflammation and the control of immune surveillance (i.e., recognition of viral pathogens). Reverse transcriptase family members are also useful in the detection and treatment of AIDS. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:128 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 286 of SEQ ID NO:128, b is an integer of 15 to 300, where both a and b correspond to the positions of nucleotide residues shown in SEQ ID NO:128, and where b is greater than or equal to a+14.

Features of Protein Encoded by Gene No: 119

The translation product of this gene shares sequence homology with reverse transcriptase, which is important in the synthesis of a cDNA copy of an RNA molecule, and is a method whereby a retrovirus reverse-transcribes its genome into an inheritable DNA copy.

This gene is expressed primarily in the frontal cortex of brain.

Therefore, polynucleotides and polypeptides of the invention are useful as reagents for differential identification of the tissue(s) or cell type(s) present in a biological sample and for diagnosis of diseases and conditions which include, but are not limited to, cancer and neurodegenerative disorders. Similarly, polypeptides and antibodies directed to these polypeptides are useful in providing immunological probes for differential identification of the tissue(s) or cell type(s). For a number of disorders of the above tissues or cells, particularly of the CNS and peripheral nervous system, expression of this gene at significantly higher or lower levels may be routinely detected in certain tissues or cell types (e.g. brain, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in the frontal cortex, combined with the homology to a reverse transcriptase suggest that this gene is useful in the treatment of cancer and AIDS, particularly of the neural system. The expression in brain indicates that it plays a role in neurodegenerative disorders and in neural degeneration. Furthermore, elevated expression of this gene product within the frontal cortex of the brain indicates that it may be involved in neuronal survival; synapse formation; conductance; neural differentiation, etc. Such involvement may impact many processes, such as learning and cognition. It may also be useful in the treatment of such neurodegenerative disorders as schizophrenia; ALS; or Alzheimer's. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:129 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1261 of SEQ ID NO:129, b is an integer of 15 to 1275, where both a and b correspond to the positions of nucleotide residues shown in SEQ ID NO:129, and where b is greater than or equal to a+14.

Features of Protein Encoded by Gene No: 120

The translation product of this gene shares homology to a hypothetical protein in Schizosaccharomyces pombe (See Genbank Accession No. 2281980). One embodiment of this gene is the polypeptide fragments comprising the following amino acid sequence: IYHLHSWIFFHFKRAFCMCFITM KVIHAHCSKLRKCXNAQISVFCTTLTASYPT (SEQ ID NO:975), IYHLHSWIFFHFKRAFCMCFITM (SEQ ID NO:976), and/or KVIHAHCSKLRKCXNAQISVFCTTL-TASYPT (SEQ ID NO:977). An additional embodiment is the polynucleotide fragments encoding these polypeptide fragments. The gene encoding the disclosed cDNA is thought to reside on chromosome 18. Accordingly, polynucleotides related to this invention are useful as a marker in linkage analysis for chromosome 18.

This gene is expressed primarily in adult hypothalamus and to a lesser extent in infant brain.

Therefore, polynucleotides and polypeptides of the invention are useful as reagents for differential identification of the tissue(s) or cell type(s) present in a biological sample and for diagnosis of diseases and conditions which include, but are not limited to, neurodegenerative disorders; endocrine function; and vertigo. Similarly, polypeptides and antibodies directed to these polypeptides are useful in providing immunological probes for differential identification of the tissue(s) or cell type(s). For a number of disorders of the above tissues or cells, particularly of the brain, CNS and peripheral nervous system, expression of this gene at significantly higher or lower levels may be routinely detected in certain tissues or cell types (e.g. brain, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in adult hypothalamus and infant brain indicates that the protein product of this gene is useful for the treatment and diagnosis of neurodegenerative disorders; diagnosis of tumors of a brain or neuronal origin; treatments involving hormonal control of the entire body and of homeostasis, behavioral disorders, such as Alzheimer's Disease, Parkinson's Disease, Huntington's Disease, schizophrenia, mania, dementia, paranoia, obsessive compulsive disorder and panic disorder. In addition, the gene or gene product may also play a role in the treatment and/or detection of developmental disorders associated with the developing embryo. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:130 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 458 of SEQ ID NO:130, b is an integer of 15 to 472, where both a and b correspond to the positions of nucleotide residues shown in SEQ ID NO:130, and where b is greater than or equal to a+14.

Features of Protein Encoded by Gene No: 121

The translation product of this gene shares sequence homology with the human IRLB protein which is thought to be important in binding to a c-myc promoter element and thus regulating its transcription (See Genbank Accession No. gi|33969). The gene encoding the disclosed cDNA is thought to reside on chromosome 1. Accordingly, polynucleotides related to this invention are useful as a marker in linkage analysis for chromosome 1. One embodiment of this gene is the polypeptide fragments comprising the following amino acid sequence: WNLLWYFQRLRLPSILPGLVLAS-CDGPSXSQAPSPWLTPDPASVQVRLLWDVLTPDPN (SEQ ID NO:978), QRGIYREILFLTMAALGKDHVDI-VAFDKKYKSAFNKLASSMGKEELRHRRAQMP (SEQ ID NO:979), and/or WNLLWYFQRLRLPSILPGLVLAS (SEQ ID NO:980). An additional embodiment is the polynucleotide fragments encoding these polypeptide fragments.

This gene is expressed primarily in brain and breast, and to a lesser extent in a variety of hematopoietic tissues and cells.

Therefore, polynucleotides and polypeptides of the invention are useful as reagents for differential identification of the tissue(s) or cell type(s) present in a biological sample and for diagnosis of diseases and conditions which include, but are not limited to, cancer of the brain and breast; lymphoproliferative disorders; neurodegenerative diseases. Similarly, polypeptides and antibodies directed to these polypeptides are useful in providing immunological probes for differential identification of the tissue(s) or cell type(s). For a number of disorders of the above tissues or cells, particularly of the CNS, breast, and immune system, expression of this gene at significantly higher or lower levels may be routinely detected in certain tissues or cell types (e.g. brain, breast, immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in brain indicates that the protein product of this gene is useful for the treatment and diagnosis of cancer of the brain, breast, and hematopoietic system. In addition, it is useful for the treatment of neurodegenerative disorders, as well as disorders of the hematopoietic system, including defects in immune competency and inflammation. Protein, as well as, antibodies directed against the protein may show utility as a tumor marker and immunotherapy targets for the above listed tumors and tissues.

Many polynucleotide sequences, such as EST sequences, are publicly available and accessible through sequence databases. Some of these sequences are related to SEQ ID NO:131 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1936 of SEQ ID NO:131, b is an integer of 15 to 1950, where both a and b correspond to the positions of nucleotide residues shown in SEQ ID NO:131, and where b is greater than or equal to a+14.

Features of Protein Encoded by Gene No: 122

The translation product of this gene shares sequence homology with an ATP synthase, a key component of the proton channel that is thought to be important in the translocation of protons across the membrane.

This gene is expressed primarily in T-cell lymphoma.

Therefore, polynucleotides and polypeptides of the invention are useful as reagents for differential identification of the tissue(s) or cell type(s) present in a biological sample and for diagnosis of diseases and conditions which include, but are not limited to, T cell lymphoma. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in T-cell lymphoma, combined with the homology to an ATP synthase indicates that the protein product of this gene is useful for the treatment of defects in proton transport, homeostasis, and metabolism, as well as the diagnosis and treatment of lymphoma. Because the gene is expressed in cells of lymphoid origin, the natural gene product may be involved in immune functions. Therefore it may be also used as an agent for immunological disorders including arthritis, asthma, immune deficiency diseases such as AIDS, and leukemia. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:132 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 976 of SEQ ID NO:132, b is an integer of 15 to 990, where both a and b correspond to the positions of nucleotide residues shown in SEQ ID NO:132, and where b is greater than or equal to a+14.

Features of Protein Encoded by Gene No: 123

The gene encoding the disclosed cDNA is thought to reside on chromosome 15. Accordingly, polynucleotides related to this invention are useful as a marker in linkage analysis for chromosome 15.

This gene is expressed primarily in a variety of fetal tissues, including fetal liver, lung, and spleen, and to a lesser extent in a variety of blood cells, including eosinophils and T cells.

Therefore, polynucleotides and polypeptides of the invention are useful as reagents for differential identification of the tissue(s) or cell type(s) present in a biological sample and for diagnosis of diseases and conditions which include, but are not limited to, cancer (abnormal cell proliferation); T cell lymphomas; and hematopoietic disorders. Similarly, polypeptides and antibodies directed to these polypeptides are useful in providing immunological probes for differential identification of the tissue(s) or cell type(s). For a number of disorders of the above tissues or cells, particularly of the fetus and immune system, expression of this gene at significantly higher or lower levels may be routinely detected in certain tissues or cell types (e.g. fetal, immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in fetal tissues indicates that the protein product of this gene is useful for the treatment and diagnosis of conditions involving cell proliferation. Similarly, the fetal tissue expression, as well as the expression in a variety of blood cell lineages, indicates that it may play a role in either cellular proliferation, apoptosis, or cell survival. Thus it may be useful in the management and treatment of a variety of cancers and malignancies. In addition, its expression in blood cells indicates that it may play additional roles in hematopoietic disorders and conditions, and could be useful in treating diseases involving autoimmunity, immune modulation, immune surveillance, and inflammation. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:133 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1706 of SEQ ID NO:133, b is an integer of 15 to 1720, where both a and b correspond to the positions of nucleotide residues shown in SEQ ID NO:133, and where b is greater than or equal to a+14.

Features of Protein Encoded by Gene No: 124

This gene is expressed primarily in placenta, and to a lesser extent in pineal gland and rhabdomyosarcoma.

Therefore, polynucleotides and polypeptides of the invention are useful as reagents for differential identification of the tissue(s) or cell type(s) present in a biological sample and for diagnosis of diseases and conditions which include, but are not limited to, developmental, endocrine, and female reproductive disorders. Similarly, polypeptides and antibodies directed to these polypeptides are useful in providing immunological probes for differential identification of the tissue(s) or cell type(s). For a number of disorders of the above tissues or cells, particularly of the placenta and endocrine system, expression of this gene at significantly higher or lower levels may be routinely detected in certain tissues or cell types (e.g. placental, endocrine, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 372 as residues: Leu-69 to Val-76.

The tissue distribution in placenta indicates that the protein product of this gene is useful for the diagnosis and treatment of developmental disorders. Furthermore, the tissue distribution indicates that the protein product of this gene is useful for the diagnosis and/or treatment of disorders of the placenta. Specific expression within the placenta indicates that this gene product may play a role in the proper establishment and maintenance of placental function. Alternately, this gene product may be produced by the placenta and then transported to the embryo, where it may play a crucial role in the development and/or survival of the developing embryo or fetus. Expression of this gene product in a vascular-rich tissue such as the placenta also indicates that this gene product may be produced more generally in endothelial cells or within the circulation. In such instances, it may play more generalized roles in vascular function, such as in angiogenesis. It may also be produced in the vasculature and have effects on other cells within the circulation, such as hematopoietic cells. It may serve to promote the proliferation, survival, activation, and/or differentiation of hematopoietic cells, as well as other cells throughout the body. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:134 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 691 of SEQ ID NO:134, b is an integer of 15 to 705, where both a and b correspond to the positions of nucleotide residues shown in SEQ ID NO:134, and where b is greater than or equal to a+14.

Features of Protein Encoded by Gene No: 125

Contact of cells with supernatant expressing the product of this gene increases the permeability of THP-1 Monocyte cells to calcium. Thus, it is likely that the product of this gene is involved in a signal transduction pathway that is initiated when the product of this gene binds a receptor on the surface of the Monocyte cell. Thus, polynucleotides and polypeptides have uses which include, but are not limited to, activating monocyte cells.

This gene is expressed primarily in benign prostatic hyperplasia.

Therefore, polynucleotides and polypeptides of the invention are useful as reagents for differential identification of the tissue(s) or cell type(s) present in a biological sample and for diagnosis of benign prostatic hyperplasia. Similarly, polypeptides and antibodies directed to these polypeptides are useful in providing immunological probes for differential identification of the tissue(s) or cell type(s). For a number of disorders of the above tissues or cells, particularly of the reproductive system, expression of this gene at significantly higher or lower levels may be routinely detected in certain tissues or cell types (e.g. reproductive, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in benign prostatic hyperplasia tissue indicates that the protein product of this gene is useful for the treatment and diagnosis of proliferative disorders of the prostate. Furthermore, the biological activity data indicates that the translation product of this gene is useful for the stimulation of certain immune system cells, such as monocytes, which may be useful for helping the body to defend against infection. Protein, as well as, antibodies directed against the protein may show utility as a tumor marker and immunotherapy targets for the above listed tumors and tissues.

Many polynucleotide sequences, such as EST sequences, are publicly available and accessible through sequence databases. Some of these sequences are related to SEQ ID NO:135 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 309 of SEQ ID NO:135, b is an integer of 15 to 323, where both a and b correspond to the positions of nucleotide residues shown in SEQ ID NO:135, and where b is greater than or equal to a+14.

Features of Protein Encoded by Gene No: 126

This gene is expressed primarily in Raji cells.

Therefore, polynucleotides and polypeptides of the invention are useful as reagents for differential identification of the tissue(s) or cell type(s) present in a biological sample and for diagnosis of diseases and conditions which include, but are not limited to, inflammation and T cell autoimmune disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in Raji cells indicates that the protein product of this gene is useful for treatment and diagnosis of inflammation and T cell autoimmune disorders. Because the gene is expressed in cells of lymphoid origin, the natural gene product may be involved in immune functions. Therefore it may be also used as an agent for immunological disorders including arthritis, asthma, immune deficiency diseases (such as AIDS), and leukemia. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:136 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 568 of SEQ ID NO:136, b is an integer of 15 to 582, where both a and b correspond to the positions of nucleotide residues shown in SEQ ID NO:136, and where b is greater than or equal to a+14.

Features of Protein Encoded by Gene No: 127

This gene is expressed primarily in apoptotic T-cells, and to a lesser extent in suppressor T cells and ulcerative colitis.

Therefore, polynucleotides and polypeptides of the invention are useful as reagents for differential identification of the tissue(s) or cell type(s) present in a biological sample and for diagnosis of diseases and conditions which include, but are not limited to, diseases involving premature apoptosis, and immunological and gastrointestinal disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, gastrointestinal, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 375 as residues: Asp-23 to Gly-29.

The tissue distribution in apoptotic T-cells indicates that the protein product of this gene is useful for the treatment and diagnosis of disorders involving inappropriate levels of apoptosis, especially in immune cell lineages. Because the gene is expressed in cells of lymphoid origin, the natural gene product may be involved in immune functions. Therefore it may be also used as an agent for immunological disorders including arthritis, asthma, immune deficiency diseases (such as AIDS), and leukemia. Furthermore, expression of this gene product in T cells also strongly indicates a role for this protein in immune function and immune surveillance. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:137 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1007 of SEQ ID NO:137, b is an integer of 15 to 1021, where both a and b correspond to the positions of nucleotide residues shown in SEQ ID NO:137, and where b is greater than or equal to a+14.

Features of Protein Encoded by Gene No: 128

The translation product of this gene shares sequence homology with an C. elegans coding region C47D12.2 of unknown function (See Genbank Accession No. gnl|PID|e348986). One embodiment for this gene is the polypeptide fragments comprising the following amino acid sequence: EDDGFNRSIHEVILKNITVYSERVL TEISLGSLLILVVIRTIQYNMTRTRDKYLHT-NCLAALANMSAQFRSLHQYAAQRIISLF-SLLSKKHNKVLEQATQSLRGSLSSNDVPLPDYAQDL NVIEEVIRMMLEIINSCLTNSLHHNPNLVYALLYKR DLFEQFRTHPSFQDIMQNIDLVISFFSSRLLQAGS (SEQ ID NO:981), EDDGFNRSIHEVILKNITWYSERV-LTEISLGSLLILVV (SEQ ID NO:982), RTIQYNMTR-TRDKYLHTNCLAALANMSAQFRSL-HQYAAQRIISLFSLLSKKHN (SEQ ID NO:983), SCLTNSLHHNPNLVYALLYKRDLFEQ-FRTHPSFQDIMQNIDLVISFFSSRLLQAGS (SEQ ID NO:984), KKHNKVLEQATQSLRGSLSSNDVPLP-DYAQD (SEQ ID NO:985), TISNSSFISGYNAKY (SEQ ID NO:986), and/or LKVAASWELSCQWNGSWKSL-SKASLRCPKTD (SEQ ID NO:987). An additional embodiment is the polynucleotide fragments encoding these polypeptide fragments. The gene encoding the disclosed cDNA is thought to reside on chromosome 18. Accordingly, polynucleotides related to this invention are useful as a marker in linkage analysis for chromosome 18.

This gene is expressed primarily in smooth muscle, and to a lesser extent in fetal liver/spleen.

Therefore, polynucleotides and polypeptides of the invention are useful as reagents for differential identification of the tissue(s) or cell type(s) present in a biological sample and for diagnosis of diseases and conditions which include, but are not limited to, atherosclerosis and other cardiovascular and hepatic disorders. Similarly, polypeptides and antibodies directed to these polypeptides are useful in providing immunological probes for differential identification of the tissue(s) or cell type(s). For a number of disorders of the above tissues or cells, particularly of the circulatory system, expression of this gene at significantly higher or lower levels may be routinely detected in certain tissues or cell types (e.g. muscle, fetal liver/spleen, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in smooth muscle indicates that the protein product of this gene is useful for the diagnosis and treatment of circulatory system disorders such as atherosclerosis, hypertension, stroke, aneurysms, embolisms, and thrombosis. In addition, the tissue distribution indicates that the protein product of this gene is useful for the detection and treatment of liver disorders and cancers (e.g. hepatoblastoma, jaundice, hepatitis, liver metabolic diseases and conditions that are attributable to the differentiation of hepatocyte progenitor cells). In addition the expression in fetus indicates a useful role for the protein product in developmental abnormalities, fetal deficiencies, pre-natal disorders and various would-healing models and/or tissue trauma. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:138 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1763 of SEQ ID NO:138, b is an integer of 15 to 1777, where both a and b correspond to the positions of nucleotide residues shown in SEQ ID NO:138, and where b is greater than or equal to a+14.

Features of Protein Encoded by Gene No: 129

The translation product of this gene shares sequence homology with a ribosomal protein which is thought to be important in cellular metabolism, in addition to the C.elegans protein F40F11.1 which does not have a known function at the current time (See Genbank Accession No. gnl|PID|e244552 ). Preferred polypeptide fragments comprise the following amino acid sequence: MADIQTER-AYQKQPTIFQNKKRVLLGETGKEKL-PRVTNKNIGLGFKDTPRRLLRGTYIDKKCPFTGNVSI RGRILSGVVTQDEDAEDHCHPPRLSALH-PQVQPLREA PQEHVCTPVPLLQGRPDR (SEQ ID NO:988), MKMQRTRDYLHYIRKYNRFEKRHKNMS-VHLSPCFRDVQIGDIVTVGECRPLSK-TVRFNVLKVTKAAGTKKQFQKF (SEQ ID NO:989), MADIQTERAYQKQPTIFQNKKRVLLGETGK (SEQ ID NO:990), KLPRVTNKNIGLGFKDTPRRLLRGTYID-KKCPFTGNVSIRGRILSGVVTQDEDAEDHC (SEQ ID NO:991), HCHPPRLSALHPQVQPLREAPQEHVCT-PVPLLQGRPDR (SEQ ID NO:992), MKMQRTIVIR-RDYLIIYIRKYNRFEKRHKNMSVHLSP (SEQ ID NO:993), CFRDVQIGDIVTVGECRPLSKTVRFNV-LKVTKAAGTKKQFQKF (SEQ ID NO:994), PRRLLRG-TYIDKKCPFTGNVSIRGRILSGVVTQ (SEQ ID NO:995), SRGTGVQTCSCGASRSGCTCGCSADSLGG (SEQ ID NO:996), and/or QWSSASSSWVTTPERIRPRM-DTLPVKGHFLSM (SEQ ID NO:997). Also preferred are the polynucleotide fragments encoding these polypeptide fragments. The gene encoding the disclosed cDNA is thought to reside on chromosome 19. Accordingly, polynucleotides related to this invention are useful as a marker in linkage analysis for chromosome 19.

This gene is expressed primarily in Wilm's tumor, and to a lesser extent in thymus and stromal cells.

Therefore, polynucleotides and polypeptides of the invention are useful as reagents for differential identification of the tissue(s) or cell type(s) present in a biological sample and for diagnosis of diseases and conditions which include, but are not limited to, Kidney disorders and cancer, diseases affecting RNA translation. Similarly, polypeptides and antibodies directed to these polypeptides are useful in providing immunological probes for differential identification of the tissue(s) or cell type(s). For a number of disorders of the above tissues or cells, particularly of the Wilm's tumors, expression of this gene at significantly higher or lower levels may be routinely detected in certain tissues or cell types (e.g. kidney, thymus, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 377 as residues: Arg-15 to Gly-22.

The tissue distribution in Wilm's tumor, combined with the homology to a ribosomal protein indicates that the protein product of this gene is useful for diseases affecting RNA translation, in addition to proliferative disorders. Furthermore, given the tissue distribution, the translation product of this gene may be useful in treating and/or detecting Wilm's tumor or tumors of other tissues mentioned previously. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:139 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 629 of SEQ ID NO:139, b is an integer of 15 to 643, where both a and b correspond to the positions of nucleotide residues shown in SEQ ID NO:139, and where b is greater than or equal to a+14.

Features of Protein Encoded by Gene No: 130

The translation product of this gene shares sequence homology with a yeast DNA helicase, which is thought to be important in global transcriptional regulation (See Genbank Accession No. gnl|PID|e243594). Preferred are the polypeptide fragments comprising the following amino acid sequence: IFYDSDWNPTVDQQAMDRAHRLGQTKQVTVYRLICKGTIEERILQRAKEKSEIQRMVISG (SEQ ID NO:998), TRMIDLLEEYMVYRKHTYXRLDGSSKISERRDMVADFQNRNDIFVFLLSTRAGGLGINLTAXDTVHF (SEQ ID NO:999), IFYDSDWNPTVDQQAMDRAHRLGQTKQVTVYR (SEQ ID NO:1000), VYRLICKGTIEERILQRAKEKSEIQRMVISG (SEQ ID NO:1001), TRMIDLLEEYMVYRKHTYXRLDGSSKISERRDM (SEQ ID NO:1002), RRDMVADFQNRNDIFVFLLSTRAGGLGINLTAXDTVHF (SEQ ID NO:1003), IFYDSDWNPTVDQQAMDRAHRLGQTKQVTVYRLICKG (SEQ ID NO:1004), IFYDSDWNPTVDQQAMDRAHRLGQTKQVTVYRLICKG (SEQ ID NO:1005), RLICKGTIEERILQRAKEKSEIQRMVISG (SEQ ID NO:1006), and/or GTRMIDLLEEYMVYRKHTYXRLDGSSKISERRDMVADFQNRNDIFVFLLSTRAGGLGINLTAXDTVHFL (SEQ ID NO:1007). An additional embodiment is the polynucleotide fragments encoding these polypeptide fragments.

This gene is expressed primarily in amygdala.

Therefore, polynucleotides and polypeptides of the invention are useful as reagents for differential identification of the tissue(s) or cell type(s) present in a biological sample and for diagnosis of diseases and conditions which include, but are not limited to, diseases and disorders of the brain and the endocrine system. Similarly, polypeptides and antibodies directed to these polypeptides are useful in providing immunological probes for differential identification of the tissue(s) or cell type(s). For a number of disorders of the above tissues or cells, particularly of the central nervous system, endocrine system, expression of this gene at significantly higher or lower levels may be routinely detected in certain tissues or cell types (e.g. brain, endocrine, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 378 as residues: Lys-24 to Tyr-34.

The tissue distribution in amygdala, combined with the homology to a DNA helicase indicates that the protein product of this gene is useful for diseases affecting RNA transcription, particularly developmental disorders and healing wounds, since the later are thought to approximate developmental transcriptional regulation. The amygdala processes sensory information and relays this to other areas of the brain including the endocrine and autonomic domains of the hypothalamus and the brain stem. Therefore, the translation product of this gene is also useful for the detection and/or treatment of disorders of the endocrine and/or neural systems. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:140 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1206 of SEQ ID NO:140, b is an integer of 15 to 1220, where both a and b correspond to the positions of nucleotide residues shown in SEQ ID NO:140, and where b is greater than or equal to a+14.

Features of Protein Encoded by Gene No: 131

This gene is expressed primarily in prostate, and to a lesser extent in amygdala and pancreatic tumors.

Therefore, polynucleotides and polypeptides of the invention are useful as reagents for differential identification of the tissue(s) or cell type(s) present in a biological sample and for diagnosis of diseases and conditions which include, but are not limited to, prostate enlargement and gastrointestinal disorders, particularly of the pancreas and gall bladder. Similarly, polypeptides and antibodies directed to these polypeptides are useful in providing immunological probes for differential identification of the tissue(s) or cell type(s). For a number of disorders of the above tissues or cells, particularly of the reproductive system, expression of this gene at significantly higher or lower levels may be routinely detected in certain tissues or cell types (e.g. reproductive, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in prostate indicates that the protein product of this gene is useful for the treatment and diagnosis of prostate or reproductive diseases, including benign prostatic hyperplasia and prostate cancer. In addition, the tissue distribution in tumors of the pancreas indicates that the protein product of this gene is useful for the diagnosis and intervention of these tumors, in addition to other tissues where expression has been indicated. Protein, as well as, antibodies directed against the protein may show utility as a tumor marker and/or immunotherapy targets for the above listed tumors and tissues.

Many polynucleotide sequences, such as EST sequences, are publicly available and accessible through sequence databases. Some of these sequences are related to SEQ ID NO:141 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 707 of SEQ ID NO:141, b is an integer of 15 to 721, where both a and b correspond to the positions of nucleotide residues shown in 15 SEQ ID NO:141, and where b is greater than or equal to a+14.

Features of Protein Encoded by Gene No: 132

The gene encoding the disclosed cDNA is thought to reside on chromosome 3.

Accordingly, polynucleotides related to this invention are useful as a marker in linkage analysis for chromosome 3.

This gene is expressed primarily in adult lung, and to a lesser extent in the hypothalamus.

Therefore, polynucleotides and polypeptides of the invention are useful as reagents for differential identification of the tissue(s) or cell type(s) present in a biological sample and for diagnosis of diseases and conditions which include, but are not limited to, pulmonary diseases and neurological disorders. Similarly, polypeptides and antibodies directed to these polypeptides are useful in providing immunological probes for differential identification of the tissue(s) or cell type(s). For a number of disorders of the above tissues or cells, particularly of the pulmonary and respiratory systems, expression of this gene at significantly higher or lower levels may be routinely detected in certain tissues or cell types (e.g. lung, brain, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in adult lung indicates that the protein product of this gene is useful for the diagnosis and treatment of pulmonary and respiratory disorders such as emphysema, pneumonia, and pulmonary edema and emboli. In addition, the tissue distribution indicates that the protein product of this gene is useful for the detection/treatment of neurodegenerative disease states and behavioural disorders such as Alzheimer's Disease, Parkinson's Disease, Huntington's Disease, schizophrenia, mania, dementia, paranoia, obsessive compulsive disorder and panic disorder. In addition, the gene or gene product may also play a role in the treatment and/or detection of developmental disorders associated with the developing embryo, sexually-linked disorders, or disorders of the cardiovascular system. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:142 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1454 of SEQ ID NO:142, b is an integer of 15 to 1468, where both a and b correspond to the positions of nucleotide residues shown in SEQ ID NO:142, and where b is greater than or equal to a+14.

Features of Protein Encoded by Gene No: 133

This gene is expressed primarily in human liver.

Therefore, polynucleotides and polypeptides of the invention are useful as reagents for differential identification of the tissue(s) or cell type(s) present in a biological sample and for diagnosis of diseases and conditions which include, but are not limited to, cirrhosis of the liver and other hepatic disorders. Similarly, polypeptides and antibodies directed to these polypeptides are useful in providing immunological probes for differential identification of the tissue(s) or cell type(s). For a number of disorders of the above tissues or cells, particularly of the digestive system, expression of this gene at significantly higher or lower levels may be routinely detected in certain tissues or cell types (e.g. liver, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in human liver indicates that the protein product of this gene is useful for the detection and treatment of liver disorders and cancers (e.g. hepatoblastoma, jaundice, hepatitis, liver metabolic diseases and conditions that are attributable to the differentiation of hepatocyte progenitor cells). Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:143 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 286 of SEQ ID NO:143, b is an integer of 15 to 300, where both a and b correspond to the positions of nucleotide residues shown in SEQ ID NO:143, and where b is greater than or equal to a+14.

Features of Protein Encoded by Gene No: 134

The gene encoding the disclosed cDNA is thought to reside on chromosome 5. Accordingly, polynucleotides related to this invention are useful as a marker in linkage analysis for chromosome 5.

This gene is expressed primarily in fetal kidney, and to a lesser extent in fetal liver and spleen.

Therefore, polynucleotides and polypeptides of the invention are useful as reagents for differential identification of the tissue(s) or cell type(s) present in a biological sample and for diagnosis of diseases and conditions which include, but are not limited to, development and regeneration of liver and kidney and immunological disorders. Similarly, polypeptides and antibodies directed to these polypeptides are useful in providing immunological probes for differential identification of the tissue(s) or cell type(s). For a number of disorders of the above tissues or cells, particularly of the digestive and excretory systems, expression of this gene at significantly higher or lower levels may be routinely detected in certain tissues or cell types (e.g. kidney, liver, spleen, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 382 as residues: Pro-70 to Arg-77, Tyr-102 to Thr-107.

The tissue distribution in fetal kidney indicates that the protein product of this gene is useful for the diagnosis and treatment of diseases of the kidney and liver, such as cirrhosis, kidney failure, kidney stones, and liver failure, hepatoblastoma, jaundice, hepatitis, liver metabolic diseases and conditions that are attributable to the differentiation of hepatocyte progenitor cells. In addition the expression in fetus would suggest a useful role for the protein product in developmental abnormalities, fetal deficiencies, pre-natal disorders and various would-healing models and/or tissue trauma. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:144 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2229 of SEQ ID NO:144, b is an integer of 15 to 2243, where both a and b correspond to the positions of nucleotide residues shown in SEQ ID NO:144, and where b is greater than or equal to a+14.

Features of Protein Encoded by Gene No: 135

This gene is expressed primarily in brain, bone marrow, and to a lesser extent in placenta, T cell, testis and neutrophils.

Therefore, polynucleotides and polypeptides of the invention are useful as reagents for differential identification of the tissue(s) or cell type(s) present in a biological sample and for diagnosis of diseases and conditions which include, but are not limited to, neurodegenerative and immunological diseases and cancer. Similarly, polypeptides and antibodies directed to these polypeptides are useful in providing immunological probes for differential identification of the tissue(s) or cell type(s). For a number of disorders of the above tissues or cells, particularly of the nervous and immune systems, expression of this gene at significantly higher or lower levels may be routinely detected in certain tissues or cell types (e.g., CNS, immune, cancerous and wounded tissues) or bodily fluids (e.g., lymph, serum, seminal fluid, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 383 as residues: Met-1 to His-6.

The tissue distribution in brain indicates that the protein product of this gene is useful for the detection/treatment of neurodegenerative disease states and behavioural disorders such as Alzheimers Disease, Parkinsons Disease, Huntingtons Disease, schizophrenia, mania, dementia, paranoia, obsessive compulsive disorder and panic disorder. In addition, the gene or gene product may also play a role in the treatment and/or detection of developmental disorders associated with the developing embryo, or sexually-linked disorders. Furthermore, the tissue distribution indicates that the protein product of this gene is useful for the diagnosis and/or treatment of hematopoietic disorders. This gene product is expressed in hematopoietic cells and tissues, suggesting that it plays a role in the survival, proliferation, and/or differentiation of hematopoieitic lineages. Expression of this gene product in T cells and neutrophils also strongly indicates a role for this protein in immune function and immune surveillance.

Many polynucleotide sequences, such as EST sequences, are publicly available and accessible through sequence databases. Some of these sequences are related to SEQ ID NO:145 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1068 of SEQ ID NO:145, b is an integer of 15 to 1082, where both a and b correspond to the positions of nucleotide residues shown in SEQ ID NO:145, and where b is greater than or equal to a+14.

Features of Protein Encoded by Gene No: 136

The translation product of this gene is homologous to the human WD repeat protein HAN11, which is thought to function in signal transduction pathways. Preferred polypeptide fragments comprise the following amino acid sequence: MSLHGKRKEIYKYEAPWTVYAMNWSVRP-DKRFRLALGSFVEEYNN-
KVQLVGLDEESSEFICRNTFDHPYPTT-KLMWIPDTKGVYPDLLATSGDYLRVWRVGETETRL ECLLNNNKNSDFCAPLTSFDWNEVDPYLLGTSSID TTCTIWGLETGQVLGRVNLVSGHVKTQLIAHDKEV YDIAFSRAGGGRDMFASVGADGSVRMFDLRHLEHS TIIYEDPQHHPLLRLCWNKQDPNYLATMAMDGMEW ILDVRVPAHLXPGTTIEHVSMALLGPHIHPATSAL QRMTTRLSSGTSSKCPEPLRTLSWPTQLXGEINNV QWASTQPELSPSATTTAWRYSECSVGGAVPTRQGL
LYFLPLPHPQS (SEQ ID NO:1008), MSLHGKRKEIYK-
YEAPWTVYAMNWSVRPDKRFRLALGS-
FVEEYNNKVQLVGLDEESSEFICRN-
TFDHPYPTTKLMWIPDTKGVYPDLLATSGDYLRVW
RVGETETRLECLLNNNKNSDFCAPLTSFDWNEVDP
YLL (SEQ ID NO: 1009), SFDWNEVDPYLLGTSSIDT-
TCTIWGLETGQVLGRVNLVSGHVKTQLI-
AHDKEVYDIAFSRAGGGRDMFASV-
GADGSVRMFDLRHLEHSTIIYEDPQHHPLLRLCWNK
QDPNYLATMAMDGMEVVILDVRVPAHLXPGTTI
(SEQ ID NO: 1010), and/or VGADGSVRMFDLRHLEH-
STIIYEDPQHHPLLRLCWNKQDPNYLAT-
MAMDGMEVVILDVRVPAHLXPGTTIEH-
VSMALLGPHIHPATSALQRMTTRLSSGTSSKCPEPLR
TLSWPTQLXGEINNVQWASTQPELSPSATTTAWRYSE
CSVGGAVPTRQGLLYF LPLPHPQS (SEQ ID NO:1011).
Also preferred are polynucleotide fragments encoding these polypeptide fragments. The gene encoding the disclosed cDNA is thought to reside on chromosome 17. Accordingly, polynucleotides related to this invention are useful as a marker in linkage analysis for chromosome 17.

This gene is expressed primarily in placenta, embryo, T cell and fetal lung, and to a lesser extent in endothelial, tonsil and bone marrow.

Therefore, polynucleotides and polypeptides of the invention are useful as reagents for differential identification of the tissue(s) or cell type(s) present in a biological sample and for diagnosis of diseases and conditions which include, but are not limited to, immunological and developmental diseases in addition to cancers. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 384 as residues: Gly-19 to Gln-28, Pro-36 to Phe-42.

The tissue distribution in tumors of colon, ovary, and breast origins indicates that the protein product of this gene is useful for the diagnosis and intervention of these tumors, in addition to other tumors where expression has been indicated. Because the gene is expressed in cells of lymphoid origin, the natural gene product may be involved in immune functions. Therefore it may also be used as an agent for immunological disorders including arthritis, asthma, immune deficiency diseases such as AIDS, and leukemia. Protein, as well as, antibodies directed against the protein may show utility as a tumor marker and/or immunotherapy targets for the above listed tumors and tissues.

Many polynucleotide sequences, such as EST sequences, are publicly available and accessible through sequence databases. Some of these sequences are related to SEQ ID NO:146 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 4299 of SEQ ID NO:146, b is an integer of 15 to 4313, where both a and b correspond to the positions of nucleotide residues shown in SEQ ID NO:146, and where b is greater than or equal to a+14.

Features of Protein Encoded by Gene No: 137

This gene is expressed primarily in TNF and INF induced epithelial cells, T cells and kidney.

Therefore, polynucleotides and polypeptides of the invention are useful as reagents for differential identification of the tissue(s) or cell type(s) present in a biological sample and for diagnosis of diseases and conditions which include, but are not limited to, inflammatory conditions particularly inflammatory reactions in the kidney. Similarly, polypeptides and antibodies directed to these polypeptides are useful in providing immunological probes for differential identification of the tissue(s) or cell type(s). For a number of disorders of the above tissues or cells, particularly of renal system, expression of this gene at significantly higher or lower levels may be routinely detected in certain tissues or cell types (e.g. kidney, immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 385 as residues: Thr-67 to Gly-72, Gln-132 to Ala-145, Arg-150 to Pro-157.

The tissue distribution in TNF and INF induced epithelial cells indicates that the protein products of this gene are useful for treating the damage caused by inflammation of the kidney. Furthermore, the tissue distribution in kidney indicates that this gene or gene product is useful in the treatment and/or detection of kidney diseases including renal failure, nephritus, renal tubular acidosis, proteinuria, pyuria, edema, pyelonephritis, hydronephritis, nephrotic syndrome, crush syndrome, glomerulonephritis, hematuria, renal cblic and kidney stones, in addition to Wilms Tumor Disease, and congenital kidney abnormalities such as horseshoe kidney, polycystic kidney, and Falconi's syndrome. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:147 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1169 of SEQ ID NO:147, b is an integer of 15 to 1183, where both a and b correspond to the positions of nucleotide residues shown in SEQ ID NO:147, and where b is greater than or equal to a+14.

Features of Protein Encoded by Gene No: 138

The gene encoding the disclosed cDNA is thought to reside on chromosome 1. Accordingly, polynucleotides related to this invention are useful as a marker in linkage analysis for chromosome 1. (See Genbank Accession No. D63485).

This gene is expressed primarily in breast cancer and colon cancer, and to a lesser extent in thymus and fetal spleen.

Therefore, polynucleotides and polypeptides of the invention are useful as reagents for differential identification of the tissue(s) or cell type(s) present in a biological sample and for diagnosis of diseases and conditions which include, but are not limited to, cancers, especially of the breast and colon tissues. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. breast, colon, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in tumors of colon and breast origins indicates that the protein product of this gene is useful for the diagnosis and intervention of these tumors, in addition to other tumors where expression has been indicated. Protein, as well as, antibodies directed against the protein may show utility as a tumor marker and/or immunotherapy targets for the above listed tumors and tissues.

Many polynucleotide sequences, such as EST sequences, are publicly available and accessible through sequence databases. Some of these sequences are related to SEQ ID NO:148 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 720 of SEQ ID NO:148, b is an integer of 15 to 734, where both a and b correspond to the positions of nucleotide residues shown in SEQ ID NO:148, and where b is greater than or equal to a+14.

Features of Protein Encoded by Gene No: 139

The gene encoding the disclosed cDNA is thought to reside on chromosome 17. Accordingly, polynucleotides related to this invention are useful as a marker in linkage analysis for chromosome 17.

This gene is expressed primarily in CD34 positive cells, and to lesser extent in activated T-cells and neutrophils.

Therefore, polynucleotides and polypeptides of the invention are useful as reagents for differential identification of the tissue(s) or cell type(s) present in a biological sample and for diagnosis of diseases and conditions which include, but are not limited to, immunologically related diseases and hematopoietic disorders. Similarly, polypeptides and antibodies directed to these polypeptides are useful in providing immunological probes for differential identification of the tissue(s) or cell type(s). For a number of disorders of the above tissues or cells, particularly of the immune system and hematopoietic system, expression of this gene at significantly higher or lower levels may be routinely detected in certain tissues or cell types (e.g. immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in CD34 positive cells, T-cells and neutrophils indicates that the protein product of this gene is useful for the treatment and diagnosis of hematopoietic disorders and immunologically related diseases, such as anemia, leukemia, inflammation, infection, allergy, immunodeficiency disorders, arthritis, asthma, immune deficiency diseases such as AIDS. Furthermore, this gene product may be involved in the regulation of cytokine production, antigen presentation, or other processes that may also suggest a usefulness in the treatment of cancer (e.g. by boosting immune responses). Since the gene is expressed in cells of lymphoid origin, the gene or protein, as well as, antibodies directed against the protein may show utility as a tumor marker and/or immunotherapy targets for the above listed tissues. In addition, this gene product may have commercial utility in the expansion of stem cells and committed progenitors of various blood lineages, and in the differentiation and/or proliferation of various cell types. Expression of this gene product in T cells and neutrophils also strongly indicates a role for this protein in immune function and immune surveillance. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:149 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1391 of SEQ ID NO:149, b is an integer of 15 to 1405, where both a and b correspond to the positions of nucleotide residues shown in SEQ ID NO:149, and where b is greater than or equal to a+14.

Features of Protein Encoded by Gene No: 140

This gene was recently published by another group, who called the gene KIAA0313 gene. (See Genbank Accession No. d1021609.) Preferred polypeptide fragments comprise the amino acid sequence: LYATATVISSPSTEXLSQDQG-DRASLDAADSGRGSWTSCSSGSHDNIQ-TIQHQRSWETLPFGHTHFDYSGDPAGL-WASSSHMDQIMFSDHSTKYNRQNQSRESLEQAQSR ASWASSTGYWGEDSEGDTGTIKRRGGKDVSIEAES SSLTSVTTEETKPVPMPAHIAVASSTTKGLIARKE GRYREPPPTPPGYIGIPITDFPEGHSHPARKPPDY NVALQRSRMVARSSDTAGPSSVQQPHGHPTSSRPV NKPQWHKXNESDPRLAPYQSQGFSTEEDEDEQVSAV (SEQ ID NO:1012), HMDQIMFSDHSTKYNRQNQS-RESLEQAQSRASWASSTGYWGE (SEQ ID NO:1013), SVTTEETKPVPMPAHIAVASSTT-KGLIARKEGRYREPPPTPPGYIGIPITD (SEQ ID NO:1014), and/or VALQRSRMVARSSDTAGPSSVQQPH-GHPTSSRPVNKPQWHKXNESDPRLAPYQSQGF (SEQ ID NO:1015). Also preferred are the polynucleotide fragments encoding these polypeptide fragments. The gene encoding the disclosed cDNA is thought to reside on chromosome 4. Accordingly, polynucleotides related to this invention are useful as a marker in linkage analysis for chromosome 4. (See Genbank Accession No. AB002311).

This gene is expressed primarily in ovarian cancer, tumors of the Testis, brain, and colon.

Therefore, polynucleotides and polypeptides of the invention are useful as reagents for differential identification of the tissue(s) or cell type(s) present in a biological sample and for diagnosis of diseases and conditions which include, but are not limited to, ovarian, testical, brain and colon cancers. Similarly, polypeptides and antibodies directed to these polypeptides are useful in providing immunological probes for differential identification of the tissue(s) or cell type(s). For a number of disorders of the above tissues or cells, particularly of the male and female reproductive systems, expression of this gene at significantly higher or lower levels may be routinely detected in certain tissues or cell types (e.g. brain, testis, colon, ovary, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in tumors of colon, ovary, testis, and brain origins indicates that the protein product of this gene is useful for the diagnosis and intervention of these tumors, in addition to other tumors where expression has been indicated. Protein, as well as, antibodies directed against the protein may show utility as a tumor marker and/or immunotherapy targets for the above listed tumors and tissues.

Many polynucleotide sequences, such as EST sequences, are publicly available and accessible through sequence databases. Some of these sequences are related to SEQ ID NO:150 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2876 of SEQ ID NO:150, b is an integer of 15 to 2890, where both a and b correspond to the positions of nucleotide residues shown in SEQ ID NO:150, and where b is greater than or equal to a+14.

Features of Protein Encoded by Gene No: 141

The gene encoding the disclosed cDNA is thought to reside on chromosome 18. Accordingly, polynucleotides related to this invention are useful as a marker in linkage analysis for chromosome 18.

This gene is expressed primarily in spleen and colon cancer.

Therefore, polynucleotides and polypeptides of the invention are useful as reagents for differential identification of the tissue(s) or cell type(s) present in a biological sample and for diagnosis of diseases and conditions which include, but are not limited to, colon cancer and immunological disorders. Similarly, polypeptides and antibodies directed to these polypeptides are useful in providing immunological probes for differential identification of the tissue(s) or cell type(s). For a number of disorders of the above tissues or cells, particularly of the gastrointestinal tract and immune systems, expression of this gene at significantly higher or lower levels may be routinely detected in certain tissues or cell types (e.g. spleen, colon, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in colon tumors indicates that the protein product of this gene is useful for the diagnosis and intervention of such tumors, in addition to other tissues and cell types where expression has been indicated. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues. Protein, as well as, antibodies directed against the protein may show utility as a tumor marker and/or immunotherapy targets for the above listed tumors and tissues.

Many polynucleotide sequences, such as EST sequences, are publicly available and accessible through sequence databases. Some of these sequences are related to SEQ ID NO:151 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2385 of SEQ ID NO:151, b is an integer of 15 to 2399, where both a and b correspond to the positions of nucleotide residues shown in SEQ ID NO:151, and where b is greater than or equal to a+14.

Features of Protein Encoded by Gene No: 142

The translation product of this gene is homologous to a T cell translocation protein, a putative zinc finger factor (See Genbank Accession No. 340454), as well as to the G-protein coupled receptor TM5 consensus polypeptide (See Genbank Accession No. R50734). Preferred polypeptide fragments comprise the following amino acid sequence: CLLFVFVS-LGMRCLFWTIVYNVLYLKHKCNTVLLCYHLCSI (SEQ ID NO:1016), and/or ACSKLIPAFEMVMRAKDN-VYHLDCFACQLCNQRXCVGDKFFLKN-NXXLCQTDYEEGLMKEGYAPXVR (SEQ ID NO:1017). Also preferred are the polynucleotide fragments encoding these polypeptide fragments.

This gene is expressed primarily in fetal brain, and to a lesser extent in frontal cortex.

Therefore, polynucleotides and polypeptides of the invention are useful as reagents for differential identification of the tissue(s) or cell type(s) present in a biological sample and for diagnosis of diseases and conditions which include, but are not limited to, neurological disorders, including brain cancer. Similarly, polypeptides and antibodies directed to these polypeptides are useful in providing immunological probes for differential identification of the tissue(s) or cell type(s). For a number of disorders of the above tissues or cells, particularly of the Central Nervous System, expression of this gene at significantly higher or lower levels may be routinely detected in certain tissues or cell types (e.g. brain, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in fetal brain indicates that the protein product of this gene is useful for the detection/treatment of neurodegenerative disease states and behavioural disorders such as Alzheimers Disease, Parkinsons Disease, Huntingtons Disease, schizophrenia, mania, dementia, paranoia, obsessive compulsive disorder and panic disorder. In addition, the gene or gene product may also play a role in the treatment and/or detection of developmental disorders associated with the developing embryo. Furthermore, elevated expression of this gene product within the frontal cortex of the brain indicates that it may be involved in neuronal survival; synapse formation; conductance; neural differentiation, etc. Such involvement may impact many processes, such as learning and cognition. It may also be useful in the treatment of such neurodegenerative disorders as schizophrenia; ALS; or Alzheimer's. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:152 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 788 of SEQ ID NO:152, b is an integer of 15 to 802, where both a and b correspond to the positions of nucleotide residues shown in SEQ ID NO:152, and where b is greater than or equal to a+14.

Features of Protein Encoded by Gene No: 143

The translation product of this gene has significant homology to the Fas ligand, which is a cysteine-rich type II transmembrane protein/tumor necrosis factor receptor homolog. Mutations within this protein have been shown to result in generalized lymphoproliferative diseases leading to the development of lymphadenopathy and autoimmune disease (See Medline Article No. 94185175). Preferred polypeptide fragments comprise the following amino acid sequence: SALSEPGAPDRRRPCPESVPRRPDDEQW-PPPTALCLDVAPLPPSS (SEQ ID NO:1018). Also preferred are polynucleotide fragments encoding these polypeptide fragments (See Genbank Accession No. 473565).

This gene is expressed primarily in osteoblasts, lung, and brain.

Therefore, polynucleotides and polypeptides of the invention are useful as reagents for differential identification of the tissue(s) or cell type(s) present in a biological sample and for diagnosis of diseases and conditions which include, but are not limited to, osteoblast-related, pulmonary, neurological, and immunological diseases. Similarly, polypeptides and antibodies directed to these polypeptides are useful in providing immunological probes for differential identification of the tissue(s) or cell type(s). For a number of disorders of the above tissues or cells, particularly of the skeletal and nervous systems, expression of this gene at significantly higher or lower levels may be routinely detected in certain tissues or cell types (e.g. lung, brain, skeletal, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 391 as residues: Trp-33 to Thr-40, Lys-45 to Ile-63.

The tissue distribution in osteoblasts, lung, and brain, combined with its homology to the Fas ligand, indicates that the protein product of this gene is useful for the diagnosis and intervention of these tumors, in addition to other tumors where expression has been indicated. Protein, as well as, antibodies directed against the protein may show utility as a tumor marker and/or immunotherapy targets for the above listed tumors and tissues. Because the Fas ligand gene is known to be expressed in cells of lymphoid origin, the natural gene product may be involved in immune functions. Therefore it may be also used as an agent for immunological disorders including asthma, immune deficiency diseases such as AIDS and leukemia, and various autoimmune disorders including lupus and arthritis. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:153 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 447 of SEQ ID NO:153, b is an integer of 15 to 461, where both a and b correspond to the positions of nucleotide residues shown in SEQ ID NO:153, and where b is greater than or equal to a+14.

Features of Protein Encoded by Gene No: 144

This gene shares sequence homology with a 21.5 KD transmembrane protein in the SEC15-SAP4 intergenic region of yeast. (See Genbank Accession No. 1723971.) Preferred polypeptide fragments comprise the amino acid sequence: PVGYLDKQVPDTSVQETDRILVEKRCW-DIALGPLKQIPMNLFI (SEQ ID NO:1019), AHASES-GERWWACCGVRFGLRSIEAIGRSCCHDG-PGGLVANRGRRFKWAIELSGPGGGSRGRSDRGSGQG DSLYPVGYLDKQVPDTSVQETDRILVEKRCWDIALG PLKQIPMNLFIMYMAGNTISIFPTMMVCMMAWRPIQ ALMAISATFKMLESSSQKFLQGLVYLIGNLMGLALA VYKCQSMGLLPTHASDWLAFIEPPERMEFSGGGLLL (SEQ ID NO:1020), PVGYLDKQVPDTSVQETDRIL-VEKRCWDLALGPLKQIPMNLFI (SEQ ID NO:1022), and/or ATFKMLESSSQKFLQGLVYLIGNLMGLA-LAVYKCQSMGLLPTHASD (SEQ ID NO:1021). Also preferred are polynucleotide fragments encoding these polypeptide fragments.

This gene is expressed primarily in osteoclastoma, hemangiopericytoma, liver, lung.

Therefore, polynucleotides and polypeptides of the invention are useful as reagents for differential identification of the tissue(s) or cell type(s) present in a biological sample and for diagnosis of diseases and conditions which include, but are not limited to, osteoclastoma, hemangiopericytoma, liver and lung tumors. Similarly, polypeptides and antibodies directed to these polypeptides are useful in providing immunological probes for differential identification of the above tissue(s) or cell type(s). For a number of disorders of the above tissues or cells, particularly of the lung and liver systems, expression of this gene at significantly higher or lower levels may be routinely detected in certain tissues or cell types (e.g. lung, liver, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution indicates that the protein product of this gene is useful for the diagnosis and/or treatment of tumors of the osteoclastoma, hemangiopericytoma, liver and lung, in addition to other tumors where expression has been indicated. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:154 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2374 of SEQ ID NO:154, b is an integer of 15 to 2388, where both a and b correspond to the positions of nucleotide residues shown in SEQ ID NO:154, and where b is greater than or equal to a+14.

Features of Protein Encoded by Gene No: 145

The translation product of this gene shares homology with the glucagon-69 gene which may indicate this gene plays a role in regulating metabolism. (See Genbank Accession No. A60318) Preferred are the polypeptide fragments comprising the following amino acid sequence: PTTKLDIMEKKKHIQIRFPSFYHKLVDSGRMRSKRETRREDSDTKHNL (SEQ ID NO:1023), FLWKSLLLRYFKMRQH (SEQ ID NO:1024), and/or YHYLLSSFLSYSSSSQNLPVYGRKMGTLFECVFFFP (SEQ ID NO:1025). An additional embodiment is the polynucleotide fragments encoding this polypeptide fragment.

This gene is expressed primarily in brain, kidney, colon, and testis.

Therefore, polynucleotides and polypeptides of the invention are useful as reagents for differential identification of the tissue(s) or cell type(s) present in a biological sample and for diagnosis of diseases and conditions which include, but are not limited to, brain, kidney, colon, and testicular cancer. Similarly, polypeptides and antibodies directed to these polypeptides are useful in providing immunological probes for differential identification of the tissue(s) or cell type(s). For a number of disorders of the above tissues or cells, particularly of the male reproductive system, neurological, circulatory, and gastrointestinal sysyems, expression of this gene at significantly higher or lower levels may be routinely detected in certain tissues or cell types (e.g. brain, kidney, colon, testis, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in brain, kidney, colon, and testis origins, indicates that the protein product of this gene is useful for the diagnosis and intervention of tumors of these tissues. The protein product of this gene is useful for the detection/treatment of neurodegenerative disease states, behavioural disorders, or inflamatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses , autism, and altered bahaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Moreover, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues. Protein, as well as, antibodies directed against the protein may show utility as a tumor marker and/or immunotherapy targets for the above listed tumors and tissues. The tissue distribution indicates that the protein product of this gene is useful for the detection/treatment of neurodegenerative disease states and behavioural disorders such as Alzheimers Disease, Parkinsons Disease, Huntingtons Disease, schizophrenia, mania, dementia, paranoia, obsessive compulsive disorder and panic disorder. In addition, the gene or gene product may also play a role in the treatment and/or detection of developmental disorders associated with the developing embryo, sexually-linked disorders, or disorders of the cardiovascular system.

Many polynucleotide sequences, such as EST sequences, are publicly available and accessible through sequence databases. Some of these sequences are related to SEQ ID NO:155 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 628 of SEQ ID NO:155, b is an integer of 15 to 642, where both a and b correspond to the positions of nucleotide residues shown in SEQ ID NO:155, and where b is greater than or equal to a+14.

Features of Protein Encoded by Gene No: 146

The translation product of this gene shares sequence homology with goliath protein, which is a Drosophila protein thought to be important in the regulation of gene expression during development. Protein may serve as a transcription factor. Preferred are the polypeptide fragments comprising the following amino acid sequence: TEHIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIV (SEQ ID NO:1026), MTHPGTEHIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF (SEQ ID NO:1027), TEHIIAVMITELRGKDILSYLEKNISVQMTIAVGTRMPPKNFSRGSLVFVSISFIVLMIISSAWLIFYF (SEQ ID NO:1028), SISFIVLMIISSAWLIFYFIQKIRYTNARDRNQRRLGDAAKKAISKLTTRTVKKGDKE (SEQ ID NO:1029), VKKGDKETDPDFDHCAVCIESYKQNDVVRILPCKHVFHKSCVDPWLSEHCTCPMCKLNILKALGIV (SEQ ID NO:1030), MTHPGTEHIIAVMITELRGKDILSYLEKNISVQMTIAVGTRMPPKNFSRGSLVFVSISFIVLMIISSAWLIFYFIQKIRYTNARDRNQRRLGDAAKKAISKLTTRT (SEQ ID NO:1031), AAKKAISKLTTRTVKKGDKETDPDFDHCAVCIESYK QNDVVRILPCKHVFHKSCVDPWLSEHCTCPMCKLNI LKALGIVPNLPC(SEQ ID NO:1032), TQAVNRRSALGDLAGDNSLGLEPLRTSGISPLPQDGELTPRTGEINIAVTKEWFIASFGLLSALTLCYMIIRATASLNANEVEWF (SEQ ID NO:1033), PLHGVADHLGCDPQTRFFVPPNIKQWIALLQRGNCTFKEKISRAAFHNAVAVVIYNNKSKEEPVTMTHPGTEHIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAV CIESYKQNDVVRILPCKHVFHKSCVDPWLSEHCTCPMC KLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF (SEQ ID NO:1034), and/or HGVADHLGCDPQTRFFVPPNIKQWIALLQRGNCTFKEKISRAAFHNAVAVVIYNNKSKEE (SEQ ID NO:1035). An additional embodiment is the polynucleotide fragments encoding these polypeptide fragments (See Genbank Accession No. 157535). When tested against Jurkat cell lines, supernatants removed from cells containing this gene activated the GAS assay. Thus, it is likely that this gene activates T-cells through the Jak-STAT signal transduction pathway. The gamma activating sequence (GAS) is a promoter element found upstream of many genes which are involved in the Jak-STAT pathway. The Jak-STAT pathway is a large, signal transduction pathway involved in the differentiation and proliferation of cells. Therefore, activation of the Jak-STAT pathway, reflected by the binding of the GAS element, can be used to indicate proteins involved in the proliferation and differentiation of cells.

This gene is expressed primarily in macrophage, breast, kidney and to a lesser extent in synovium, hypothalamus and rhabdomyosarcoma.

Therefore, polynucleotides and polypeptides of the invention are useful as reagents for differential identification of the tissue(s) or cell type(s) present in a biological sample and for diagnosis of diseases and conditions which include, but are not limited to, schizophrenia and cancer. Similarly, polypeptides and antibodies directed to these polypeptides are useful in providing immunological probes for differential identification of the tissue(s) or cell type(s). For a number of disorders of the above tissues or cells, particularly of the immune and neural system, expression of this gene at significantly higher or lower levels may be routinely detected in certain tissues or cell types (e.g. brain, kidney, immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in macrophage, hypothalamus, and kidney, combined with the homology to a zinc finger protein indicates that the protein product of this gene is useful for the treatment of schizophrenia, kindey disease and other cancers. Furthermore, the tissue distribution in macrophage, breast, and kidney origins indicates that the protein product of this gene is useful for the diagnosis and intervention of tumors within these tissues, in addition to other tumors where expression has been indicated. Protein, as well as, antibodies directed against the protein may show utility as a tumor marker and/or immunotherapy targets for the above listed tumors and tissues. Because the gene is expressed in cells of lymphoid origin, the natural gene product may be involved in immune functions. Therefore it may be also used as an agent for immunological disorders including arthritis, asthma, immune deficiency diseases such as AIDS, and leukemia.

Many polynucleotide sequences, such as EST sequences, are publicly available and accessible through sequence databases. Some of these sequences are related to SEQ ID NO:156 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1237 of SEQ ID NO:156, b is an integer of 15 to 1251, where both a and b correspond to the positions of nucleotide residues shown in SEQ ID NO:156, and where b is greater than or equal to a+14.

Features of Protein Encoded by Gene No: 147

The translation product of this gene shares sequence homology with HNP36 protein, an equilibrative nucleoside transporter, which is thought to be important in gene transcription as well as serving as an important component of the nucleoside transport apparatus (See Genbank Accession No. 1845345). Preferred are the polypeptide fragments comprising the following amino acid sequence: MSGQGLAGFFASVAMICAIASGSELSESAFGYFITAC AVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSWXLARLVFVPLLLLCNIKPRRYLTVVFEHDAWFIFFMAAFSNGYLASLCMCFGPKKVKPAEAETAEPSWPSS CVWVWHWGLFSPSCSGQLCDKGWTEGLPASLPVCLLP LPSARGDPEWSGGFFF(SEQ ID NO:1036), MSGQGLAGFFASVAMICAIASGSELS-
ESAFGYFITACAVIILTIICYLGLPRLE-
FYRYYQQLKLEGPGEQETKLDLISK-
GEEPRAGKEESGVSVSNSQPTNESHSI (SEQ ID
NO:1037), SGVSVSNSQPTNESHSIKAILKNISV-
LAFSVCFIFTITIGMFPAVTVEVKS-
SIAGSSTWERYFIPVSCFLTFNIFDWLGRS (SEQ ID
NO:1038), TIGMFPAVTVEVKSSIAGSSTWERY-
FIPVSCFLTFNIFDWLGRSLTAVFMW-
PGKDSRWLPSWXLARLVFVPLLLLCNI-
KPRRYLTVVFEHDA (SEQ ID NO:1039), and/or
FGPKKVKPAEAETAEPSWPSSCVWVWH-
WGLFSPSCSGQLCDKGWTEGLPASLPV-
CLLPLPSARGDPEWSGGFFF (SEQ ID NO:1040). An additional embodiment is the polynucleotide fragments encoding these polypeptide fragments. The gene encoding the disclosed cDNA is thought to reside on chromosome 6. Accordingly, polynucleotides related to this invention are useful as a marker in linkage analysis for chromosome 6.

This gene is expressed primarily in eosinophils and aortic endothelium, and to a lesser extent in umbilical vein endothelial cell and thymus.

Therefore, polynucleotides and polypeptides of the invention are useful as reagents for differential identification of the tissue(s) or cell type(s) present in a biological sample and for diagnosis of diseases and conditions which include, but are not limited to, haemopoietic disease. Similarly, polypeptides and antibodies directed to these polypeptides are useful in providing immunological probes for differential identification of the tissue(s) or cell type(s). For a number of disorders of the above tissues or cells, particularly of the circulatory system, expression of this gene at significantly higher or lower levels may be routinely detected in certain tissues or cell types (e.g. circulatory, immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution eosinophils and aortic endothelium, combined with the homology to the HNP36 protein indicates that the protein product of this gene is useful for the treatment of blood neoplasias and other haemopoietic disease. Furthermore, elevated expression of this gene product by endothelial cells indicates that it may play vital roles in the regulation of endothelial cell function; secretion; proliferation; or angiogenesis. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:157 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2113 of SEQ ID NO:157, b is an integer of 15 to 2127, where both a and b correspond to the positions of nucleotide residues shown in SEQ ID NO:157, and where b is greater than or equal to a+14.

Features of Protein Encoded by Gene No: 148

The gene encoding the disclosed cDNA is thought to reside on chromosome 5. Accordingly, polynucleotides related to this invention are useful as a marker in linkage analysis for chromosome 5.

This gene is expressed primarily in breast cancer cell lines, thymus stromal cells, and ovary.

Therefore, polynucleotides and polypeptides of the invention are useful as reagents for differential identification of the tissue(s) or cell type(s) present in a biological sample and for diagnosis of diseases and conditions which include, but are not limited to, endocrine and female reproductive system diseases including breast cancer. Similarly, polypeptides and antibodies directed to these polypeptides are useful in providing immunological probes for differential identification of the tissue(s) or cell type(s). For a number of disorders of the above tissues or cells, particularly of the endocrine system, expression of this gene at significantly higher or lower levels may be routinely detected in certain tissues or cell types (e.g. thymus, ovary, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in breast cancer cells and ovary indicates that the protein product of this gene is useful for the diagnosis and treatment of endocrine disorders. In addition, the tissue distribution in tumors of thymus, ovary, and breast origins indicates that the protein product of this gene is useful for diagnosis and intervention of these tumors, in addition to other tumors where expression has been indicated. Protein, as well as, antibodies directed against the protein may show utility as a tumor marker and/or immunotherapy targets for the above listed tumors and tissues Many polynucleotide sequences, such as EST sequences, are publicly available and accessible through sequence databases. Some of these sequences are related to SEQ ID NO:158 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1611 of SEQ ID NO:158, b is an integer of 15 to 1625, where both a and b correspond to the positions of nucleotide residues shown in SEQ ID NO:158, and where b is greater than or equal to a+14.

Features of Protein Encoded by Gene No: 149

The translation product of this gene has homology to pmtl and pmt 2, two conserved Schizosaccharomyces pombe genes. Preferred are the polypeptide fragments comprising the following amino acid sequence: DDDGFEIVPIEDPA-KHRILDPEGLALGAVIASSKKAKRDLIDNSFN RYT-FNEDEGELPEWFVQEEKQHRIRQLPVGKKEVE HYRKRWREINARPIXXXXXXXXXXXXXXXXLEQ TRKKAEAVVNTVDIXRTRES (SEQ ID NO:1041), DDDGFEIVPIEDPAKHRILDPEGLALGA-VIASSKKAKRDLIDNSFNRYTF (SEQ ID NO: 1042), and/or KRWREINARPIXXXXXXXXXXXXXXXXX-LEQTRKKAEAVVNTVDIXRTRES (SEQ ID NO:1043). An additional embodiment is the polynucleotide fragments encoding these polypeptide fragments (See Genbank Accession No. e1216734).

This gene is expressed primarily in retina and ovary, and to a lesser extent in breast cancer cells, epididymus and osteosarcoma.

Therefore, polynucleotides and polypeptides of the invention are useful as reagents for differential identification of the tissue(s) or cell type(s) present in a biological sample and for diagnosis of diseases and conditions which include, but are not limited to, neuronal growth disorders, cancer and reproductive system disorders. Similarly, polypeptides and antibodies directed to these polypeptides are useful in providing immunological probes for differential identification of the tissue(s) or cell type(s). For a number of disorders of the above tissues or cells, particularly of the neural and reproductive system, expression of this gene at significantly higher or lower levels may be routinely detected in certain tissues or cell types (e.g. retina, ovary, reproductive, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 397 as residues: Met-1 to Gly-7.

The tissue distribution in ovary, breast cancer cells, and epididymus indicates that the protein product of this gene is useful for the diagnosis or treatment of reproductive system diseases and cancers, in addition to other tumors where expression has been indicated. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:159 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1673 of SEQ ID NO:159, b is an integer of 15 to 1687, where both a and b correspond to the positions of nucleotide residues shown in SEQ ID NO:159, and where b is greater than or equal to a+14.

Features of Protein Encoded by Gene No: 150

Preferred are the polypeptide fragments comprising the following amino acid sequence: MIKDKGRARTALTSSQPAHLCPENPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPEEDILQVVKYCTDLIEEK DLEKLDLVIKYMKRLMQQSVESVWNMAFDFILDNVQ VVLQQTYGSTLKVT (SEQ ID NO:1044), MIKDKGRARTALTSSQPAHLCPENPLLHLKAAVKEKKRNKKKKTIGSPKRIQ (SEQ ID NO:1045), KRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPM (SEQ ID NO:1046), TISDPMEEDILQVVKYCTDLIEEKDLEKLDLVIKYMKRLMQQSVESVWNMAFILDNVQVVLQQTYGSTLKVT (SEQ ID NO:1047), VCCKTTWTLSRIKSNAIFQTDSTDCCISLFMYFITRSSFSKSF SSIRSVQYFTTWRMSSSIGSEIVVIHSLSKVFTSLNSTAPARLGAGGLTQPAGSDCKLERPGTPEVEAESSSRGFS AGGPSCFRNPSINFWGLPQAPGRVFAGLLSSLLFKGL (SEQ ID NO:1048), WTLSRIKSNAIFQTDSTDCCISLFM (SEQ ID NO:1049), FTTWRMSSSIGSEIVVIHSLSKVFTSLNSTAPARLGA (SEQ ID NO:1050), and/or GGPSCFRNPSINFWGLPQAPGRVFAGLL (SEQ ID NO:1051). An additional embodiment is the polynucleotide fragments encoding these polypeptide fragments. The gene encoding the disclosed cDNA is believed to reside on chromosome 2. Accordingly, polynucleotides related to this invention are useful as a marker in linkage analysis for chromosome 2.

This gene is expressed primarily in 12 week embryo, and to a lesser extent, in hemangiopericytoma and frontal cortex.

Therefore, polynucleotides and polypeptides of the invention are useful as reagents for differential identification of the tissue(s) or cell type(s) present in a biological sample and for diagnosis of diseases and conditions which include, but are not limited to, developmental or neural disorders, particularly hemangiopericytoma, and other proliferative conditions, including cancers. Similarly, polypeptides and antibodies directed to these polypeptides are useful in providing immunological probes for differential identification of the tissue(s) or cell type(s). For a number of disorders of the above tissues or cells, particularly of the neural system and developing systems, expression of this gene at significantly higher or lower levels may be routinely detected in certain tissues or cell types (e.g., developmental, neural, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 398 as residues: Leu-4 to Lys-11.

The tissue distribution in embryonic and neural tissues indicates that the protein product of this gene is useful for the treatment of growth disorders, hemangiopericytoma and other soft tissue tumors. Moreover, the protein product of this gene is useful for the detection/treatment of neurodegenerative disease states, behavioural disorders, or inflamatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Moreover, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:160 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1828 of SEQ ID NO:160, b is an integer of 15 to 1842, where both a and b correspond to the positions of nucleotide residues shown in SEQ ID NO:160, and where b is greater than or equal to a+14.

Features of Protein Encoded by Gene No: 151

The translation product of this gene has been found to have homology to a human DNA mismatch repair protein PMS3 (See Genbank Accession No. R95250). Preferred polypeptide fragments comprise the following amino acid sequence: FCHDCKFPEASPAMNCEP (SEQ ID NO:1052), FCHDCKFPEASPAMNCEP (SEQ ID NO:1053), and/or HEPYAVLVI (SEQ ID NO:1054). Also preferred are polynucleotide fragments encoding these polypeptide fragments.

This gene is expressed primarily in neutrophils.

Therefore, polynucleotides and polypeptides of the invention are useful as reagents for differential identification of the tissue(s) or cell type(s) present in a biological sample and for diagnosis of diseases and conditions which include, but are not limited to, immune or hematopoietic disorders, such as lymphoma, immunodeficiency diseases, and cancers resulting from genetic instability. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 399 as residues: Met-1 to Lys-6.

The tissue distribution in neutrophils, combined with the sequence homology to a human mismatch DNA repair enzyme indicates that the protein product of this gene is useful for diagnosis of Hodgkin's lymphoma, since the elevated expression and secretion by the tumor mass may be indicative of tumors of this type. Additionally the gene product may be used as a target in the immunotherapy of the cancer. Because the gene is expressed in cells of lymphoid origin, the natural gene product may be involved in immune functions. Therefore it may be also used as an agent for immunological disorders including arthritis, asthma, immune deficiency diseases such as AIDS, and leukemia. Furthermore, its homology to a known DNA repair protein would suggest the gene may be useful in establishing cancer predisposition and prevention or be of use in gene therapy applications. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:161 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 756 of SEQ ID NO:161, b is an integer of 15 to 770, where both a and b correspond to the positions of nucleotide residues shown in SEQ ID NO:161, and where b is greater than or equal to a+14.

Features of Protein Encoded by Gene No: 152

In specific embodiments, polypeptides of the invention comprise the following amino acid sequence: PQPSNFPTTVRNLPYSGAGAQPPPSNC (SEQ ID NO:1055). Polynucleotides encoding these polypeptides are also encompassed by the invention.

This gene is expressed primarily in neutrophils.

Therefore, polynucleotides and polypeptides of the invention are useful as reagents for differential identification of the tissue(s) or cell type(s) present in a biological sample and for diagnosis of diseases and conditions which include, but are not limited to, immune or hematopoietic disorders, such as infectious diseases and lymphoma. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neutrophils indicates that the protein product of this gene is useful for the treatment of inflammation and infectious diseases. Expression of this gene product in neutrophils indicates a role in regulating the proliferation; survival; differentiation; and/or activation of hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:162 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 505 of SEQ ID NO:162, b is an integer of 15 to 519, where both a and b correspond to the positions of nucleotide residues shown in SEQ ID NO:162, and where b is greater than or equal to a+14.

Features of Protein Encoded by Gene No: 153

Preferred polypeptide fragments encoded by this gene comprise the following amino acid sequence: MASSVPAGGHTRAGGIFLIGKLDLEASLFKSFQWLPFVLRKKCNFFCWDSSAHSLPLHPLSASCSAPACHASDTHLLYPSTRALCPSIFAWLVAPHSVFRTNAPGPTPSSQSSPVFPVFPVSFMALIVCXLVCC (SEQ ID NO:1056), MASSVPAGGHTRAGGIFLIGKLDLEASLFKSFQWLPFVLRKKCNFFCWDSSAHSLPLHPLSASCSAPACHA (SEQ ID NO:1057), FAWLVAPHSVFRTNAPGPTPSSQSSPVFPVFPVSFMALIVCXLVCC (SEQ ID NO:1058), MASSVPAGGHTRAGGIFLIGKLDLEASLFKSFQWLPFVLRKKCNFFCWDSSAHSLPLHPLSASCSAPACHASDTHLLYPSTRALCPSIFAWLVAPHSVFRTNAPGPTPSSQSSPVFPVFPVSFMALIVCXLVCC (SEQ ID NO:1059), LVNWILKLHCLNLFSGFPLYLEKNATSSAGTHPLTAFPSTLSLPHALPLPAMPPILTFCTPAPVPSAPRSLPGWLLLTQCSGQMLLALPHLASLARSSLSSLFHSWLLLFVXLCAVDF (SEQ ID NO:1060), NLFSGFPLYLEKNATSSAGTHPL (SEQ ID NO:1061), and/or PHLASLARSSLSSLFHSWLLL (SEQ ID NO:1062). An additional embodiment is the polynucleotide fragments encoding these polypeptide fragments.

This gene is expressed primarily in neutrophils.

Therefore, polynucleotides and polypeptides of the invention are useful as reagents for differential identification of the tissue(s) or cell type(s) present in a biological sample and for diagnosis of diseases and conditions which include, but are not limited to, immune or hematopoietic disorders, such as inflammation and infectious diseases. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 401 as residues: Ser-11 to Pro-17.

The tissue distribution in neutrophils indicates that the protein product of this gene is useful for the treatment of infectous diseases and inflammation. Moreover, the expression of this gene product indicates a role in regulating the proliferation; survival; differentiation; and/or activation of hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:163 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 739 of SEQ ID NO:163, b is an integer of 15 to 753, where both a and b correspond to the positions of nucleotide residues shown in SEQ ID NO:163, and where b is greater than or equal to a+14.

Features of Protein Encoded by Gene No: 154

This gene is primarily expressed in ovary, uterus, adipose tissue, brain, and the liver.

Therefore, polynucleotides and polypeptides of the invention are useful as reagents for differential identification of the tissue(s) or cell type(s) present in a biological sample and for diagnosis of diseases and conditions which include, but are not limited to, reproductive, neural, hepatic, and metabolic disorders. Similarly, polypeptides and antibodies directed to these polypeptides are useful in providing immunological probes for differential identification of the tissue(s) or cell type(s). For a number of disorders of the above tissues or cells, particularly of the female reproductive system, expression of this gene at significantly higher or lower levels may be routinely detected in certain tissues or cell types (e.g., ovary, uterus, adipose tissue, brain, liver, and cancerous and wounded tissues) or bodily fluids (e.g., lymph, bile, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 402 as residues: Asn-56 to Gly-67.

The tissue distribution of this gene product in ovary and uterus indicates that the protein product of this gene is useful for diagnostic or therapeutic uses in the treatment of the female reproductive system, obesity, and liver disorders, particularly cancer in the above tissues. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:164 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1879 of SEQ ID NO:164, b is an integer of 15 to 1893, where both a and b correspond to the positions of nucleotide residues shown in SEQ ID NO:164, and where b is greater than or equal to a+14.

Features of Protein Encoded by Gene No: 155

The gene encoding the disclosed cDNA is believed to reside on chromosome 3. Accordingly, polynucleotides related to this invention are useful as a marker in linkage analysis for chromosome 3.

This gene is expressed in multiple tissues including brain, aortic endothelial cells, smooth muscle, pituitary, testis, melancytes, spleen, neutrophils, and placenta.

Therefore, polynucleotides and polypeptides of the invention are useful as reagents for differential identification of the tissue(s) or cell type(s) present in a biological sample and for diagnosis of diseases and conditions which include, but are not limited to, immunological or vascular disorders, including immunodeficiencies, cancers of the brain and the female reproductive system, as well as cardiovascular disorders, such as atherosclerosis and stroke. Similarly, polypeptides and antibodies directed to these polypeptides are useful in providing immunological probes for differential identification of the tissue(s) or cell type(s). For a number of disorders of the above tissues or cells, particularly of the central nervous and immune systems, expression of this gene at significantly higher or lower levels may be routinely detected in certain tissues or cell types (e.g., immune, vascular, endothelial, neural, hematopoietic, reproductive, integumenatary, placental, endocrine, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neural tissue indicates that the protein product of this gene is useful in the treatment/detection of disorders in the nervous system, including schizophrenia, neurodegeneration, neoplasia, brain cancer as well as vascular and female reproductive disorders, including cancer within the above tissues. Moreover, the protein product of this gene may also be useful in the treatment and/or detection of other vascular disorders which include, but are not limited to, aneurysms, emboli, thrombosis, atherosclerosis, microvascular disease, or stroke. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:165 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2139 of SEQ ID NO:165, b is an integer of 15 to 2153, where both a and b correspond to the positions of nucleotide residues shown in SEQ ID NO:165, and where b is greater than or equal to a+14.

Features of Protein Encoded by Gene No: 156

The translation product of this gene shares sequence homology with the human gene encoding cytochrome b561 (See Genbank Accession No. P10897). Cytochrome b561 is a transmembrane electron transport protein that is specific to a subset of secretory vesicles containing catecholamines and amidated peptides. This protein is thought to supply reducing equivalents to the intravesicular enzymes dopamine-beta-hydroxylase and alpha-peptide amidase. Preferred polypeptides of the invention comprise the amino acid sequence: MAMEGYWRFLALLGSALLVGFLSVI-FALVWVLHYREGLGWDGSALEFNWBPV-LMVTGFVFIQGIAIIVYRLPWTWKC-SKLLMKSIHAGLNAVAAILAIISWAVFENHNVNNIAN MYSLHSWVGLIAVICYLLQLLSGFSVFLLPWAPLSLR AFLMPIHVYSGWIIFGTVIATALMGLTEKLIFSLRDP AYSTFPPEGVFVNTLGLLILVFGALIFWIVTRPQWKR PKEPNSTILHPNGGTEQGARGSMPAY-SGNNMDKSDSE LNSEVAARKRNLALDEAGQRSTM (SEQ ID NO:1063), AHASAHASGGAEYGAL (SEQ ID NO:1064), QYSQYVQSAQLGWTDSCHMLFVTASFR-FFSLSASMGSAFSPSISHAHTCLF-WNCHLWNSDCNSTYGIDRETDFFPERS-CIQYIPARRCFRKYAWPSDPGVRGPHFLDSHQTAM ETS (SEQ ID NO:1065), ASMGSAFSPSISHAHTCLF-WNCHLWNSDCNSTYG (SEQ ID NO:1066), FVHV-VARVGWHGTSCSLFSASIWMKNGRIWLL-RTFPLRSGDYPKNEGPEHQDQKAKRIYENTFWRECT VCRISQGKNQFLCQSHKCCCNHCSKDDNSRINMYGH EKCSERKRSPWKQKD (SEQ ID NO:1067), and/or ASI-WMKNGRIWLLRTFPLRSGDYPKNEGPEHQ (SEQ ID NO:1068), as well as antigenic fragments of at least 20 amino acids of this gene and/or biologically active fragments. Also preferred are polynucleotide fragments encoding these polypeptide fragments. The gene encoding the disclosed cDNA is believed to reside on chromosome 2. Accordingly, polynucleotides related to this invention are useful as a marker in linkage analysis for chromosome 2.

This gene is expressed primarily in anergic T-cells.

Therefore, polynucleotides and polypeptides of the invention are useful as reagents for differential identification of the tissue(s) or cell type(s) present in a biological sample and for diagnosis of diseases and conditions which include, but are not limited to, immune or hematopoietic disorders, and metabolic related diseases. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, metabolic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 404 as residues: Pro-222 to Asn-231, Asn-238 to Gly-247, Ala-251 to Leu-264, Ala-280 to Thr-285.

The tissue distribution in anergic T-cells indicates that the protein product or mRNA of this gene is useful for the treatment or diagnosis of immune system and metabolic diseases or conditions including Tay-Sachs disease, phenylketonuria, galactosemia, various porphyrias, and Hurler's syndrome. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:166 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1237 of SEQ ID NO:166, b is an integer of 15 to 1251, where both a and b correspond to the positions of nucleotide residues shown in SEQ ID NO:166, and where b is greater than or equal to a+14.

Features of Protein Encoded by Gene No: 157

The translation product of this gene shares sequence homology with collagen which is important in mammalian development. This gene also shows sequence homology with bcl-2 and the HNK-1 sulfotransferase of *Rattus norvegicus* which is thought be involved in carbohydrate biosynthesis. (See Genbank Accession No. P90988 and AF022729, respectively.) When tested against Jurket cell lines, supernatants removed from cells containing this gene activated the GAS (gamma activating sequence) promoter element. Thus, it is likely that this gene activates T-cells cells through the JAK-STAT signal transduction pathway. GAS is a promoter element found upstream of many genes which are involved in the Jak-STAT pathway. The Jak-STAT pathway is a large, signal transduction pathway involved in the differentiation and proliferation of cells. Therefore, activation of the Jak-STAT pathway, reflected by the binding of the GAS element, can be used to indicate proteins involved in the proliferation and differentiation of cells. Preferred polypeptide fragments comprise the amino acid sequence: PGRAGPSPGLSLQLPAEPGHPAGNLA-PLTSRPQPLCRIPAVPG (SEQ ID NO:1069). Also preferred are polynucleotide sequences encoding this polypeptide fragment.

This gene is expressed primarily in HL-60 tissue culture cells, and to a lesser extent, in liver, breast, and uterus.

Therefore, polynucleotides and polypeptides of the invention are useful as reagents for differential identification of the tissue(s) or cell type(s) present in a biological sample and for diagnosis of diseases and conditions which include, but are not limited to, immunological diseases, hereditary disorders involving the MHC class of immune molecules, as well as developmental disorders and reproductive disorders. Similarly, polypeptides and antibodies directed to these polypeptides are useful in providing immunological probes for differential identification of the tissue(s) or cell type(s).

For a number of disorders of the above tissues or cells, particularly of the immune and reproductive system expression of this gene at significantly higher or lower levels may be routinely detected in certain tissues or cell types (e.g., reproductive, hepatic, immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 405 as residues: Ser-39 to Gly-46, Leu-49 to Ala-62.

The tissue distribution in reproductive, and immune tissues, combined with the homology to collagen and the detected GAS biological activity indicates that the protein product of this gene is useful for diagnosis and treatment of hereditary MHC disorders and particularly autoimmune disorders including rheumatoid arthritis, lupus, scleroderma, and dermatomyositis, as well as many reproductive disorders, including cancer of the uterus, and breast tissues. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:167 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 868 of SEQ ID NO:167, b is an integer of 15 to 882, where both a and b correspond to the positions of nucleotide residues shown in SEQ ID NO:167, and where b is greater than or equal to a+14.

Features of Protein Encoded by Gene No: 158

This gene is expressed primarily in the amygdala region of the brain.

Therefore, polynucleotides and polypeptides of the invention are useful as reagents for differential identification of the tissue(s) or cell type(s) present in a biological sample and for diagnosis of diseases and conditions which include, but are not limited to, a variety of brain disorders, particularly those effecting mood and personality, in addition to neurodegenerative conditions. Similarly, polypeptides and antibodies directed to these polypeptides are useful in providing immunological probes for differential identification of the tissue(s) or cell type(s). For a number of disorders of the above tissues or cells, particularly of the brain and central nervous system, expression of this gene at significantly higher or lower levels may be routinely detected in certain tissues or cell types (e.g., neural, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in the amygdala indicates that the protein product of this gene is useful for the treatment and/or diagnosis of a variety of brain disorders, particularly bi-polar disorder, uni-polar depression, and dementia. Moreover, The tissue distribution indicates that the protein product of this gene is useful for the detection/treatment of neurodegenerative disease states, behavioural disorders, or inflammatory conditions which include, but are not limited to Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Moreover, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:168 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1194 of SEQ ID NO:168, b is an integer of 15 to 1208, where both a and b correspond to the positions of nucleotide residues shown in SEQ ID NO:168, and where b is greater than or equal to a+14.

Features of Protein Encoded by Gene No: 159

This gene is expressed in a variety of tissues and cell types including brain, smooth muscle, kidney, salivary gland, and T-cells.

Therefore, polynucleotides and polypeptides of the invention are useful as reagents for differential identification of the tissue(s) or cell type(s) present in a biological sample and for diagnosis of diseases and conditions which include, but are not limited to, neural, renal, vascular, metabolic, or immune disorders, particularly cancers. Similarly, polypeptides and antibodies directed to these polypeptides are useful in providing immunological probes for differential identification of the tissue(s) or cell type(s). For a number of disorders of the above tissues or cells, particularly of the central nervous, urinary, salivary, digestive, and immune systems, expression of this gene at significantly higher or lower levels may be routinely detected in certain tissues or cell types (e.g., neural, renal, vascular, metabolic, immune cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 407 as residues: Asp-43 to Asp-60.

The tissue distribution in brain, smooth muscle, and T-cells indicates that the protein product of this gene is useful for diagnosis of various neurological, and cardiovascular disorders, but not limited to cancer within the above tissues. Additionally the gene product may be used as a target in the immunotherapy of the cancer. Because the gene is expressed in cells of lymphoid origin, the natural gene product may be involved in immune functions. Therefore it may be also used as an agent for immunological disorders including arthritis, asthma, immune deficiency diseases such as AIDS, and leukemia. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:169 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1244 of SEQ ID NO:169, b is an integer of 15 to 1258, where both a and b correspond to the positions of nucleotide residues shown in SEQ ID NO:169, and where b is greater than or equal to a+14.

Features of Protein Encoded by Gene No: 160

The translation product of this gene shares sequence homology with collagen, which is thought to be important in cellular interactions, extracellular matrix formation, and has been found to be an identifying determinant in autoimmune disorders. Moreover, this gene shows sequence homology with the yeast protein, Sls1p, an endoplasmic reticulum component involved in the protein translocation process in the Yeast Yarrowia lipolytica. (See Genbank Accession No. 1052828; see also J. Biol. Chem. 271, 11668–11675 (1996).) In *Mus musculus,* this same region shows sequence homology with the heavy chain of kinesin. (See Genbank Accession No. 2062607.) Recently, suppression of the heavy chain of kinesin was shown to inhibit insulin secretion from primary cultures of mouse beta-cells. (See Endocrinology 138 (5), 1979–1987 (1997).) Moreover, kinesin was found associated with drug resistance and cell immortalization. (See Genbank Accession No. 468355.) Thus, it is likely that this gene also acts as a genetic suppressor element. In specific embodiments, polypeptides of the invention comprise the following amino acid sequence: ARGRRRGRLEL-WELCLPLGCRRRRSLTMAPQSLPSSRMAPLG (SEQ ID NO:1070), NGQASTAKMSSCLRSPPTLAPLSLTS-GIPVQSWCGASSQLLQQAVDRAQQLL-EVALVLTILQLQAGQHLVLSLQAGQC-PAELGVLTVAVPAGGQEDAQCLQHLLTGIMLGQRQE VGRDLAPALFPQAWQEVYLAMLLQLL-WGHLLGQLSL LLGEHLLRDQVVEQCDHAHGEHL-RALLLHQGPQDLQ PPELQELPLGIGEVAQQGAQCK-QDLLLCSERLLRGQ DDQQLLQGSPFDGLHLDLGVAGKGSAQHKRSILLHE GLCAVQPIDHHLKTTKGKQVLRIVHLMDIIFKIKER SNLLFQTGAGTIELVDQPYHDLHVSLNDNIQLIKVF LQFLNGAEEPLYLSLPCLVFL (SEQ ID NO:1071), QHLVLSLQAGQCPAELGVLTVAVPAGGQEDAQC (SEQ ID NO:1072), QLSLLLGEHLLRDQVVEQCDHAH-GEH (SEQ ID NO:1073), GSPFDGLHLDLGVAGKG-SAQHKRSILLHEGLC (SEQ ID NO:1074), and/or HLM-DIIFKIKERSNLLFQTGAGTIELVDQP (SEQ ID NO:1075). Polynucleotides encoding these polypeptides are also encompassed by the invention. The gene encoding the disclosed cDNA is believed to reside on chromosome 5. Accordingly, polynucleotides related to this invention are useful as a marker in linkage analysis for chromosome 5.

This gene is expressed primarily in the greater omentum, and to a lesser extent in gall bladder, stromal bone marrow cells, lymph node, liver, testes, pituitary, and thymus.

Therefore, polynucleotides and polypeptides of the invention are useful as reagents for differential identification of the tissue(s) or cell type(s) present in a biological sample and for diagnosis of diseases and conditions which include, but are not limited to, disorders of the endocrine, gastrointestinal, and immunological systems, including autoimmune disorders and cancers. Similarly, polypeptides and antibodies directed to these polypeptides are useful in providing immunological probes for differential identification of the tissue(s) or cell type(s). For a number of disorders of the above tissues or cells, particularly of the immune and gastrointestinal systems, expression of this gene at significantly higher or lower levels may be routinely detected in certain tissues or cell types (e.g., gastrointestinal, metabolic, immune, hematopoietic, hepatic, reproductive, endocrine, and cancerous and wounded tissues) or bodily fluids (e.g., lymph, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 408 as residues: Asn-27 to Leu-47, Gln-81 to Lys-88, Asp-93 to Lys-102, Asn-107 to Leu-116, Met-129 to Glu-141, Glu-150 to Asp-157, Lys-176 to Glu-185, Glu-333 to Tyr-349, Cys-393 to Leu-403, Gln-423 to Gly-429.

The tissue distribution within gastrointestinal, endocrine and immunological tissues, combined with the sequence homology to a conserved collagen motif, indicates that the protein product of this gene is useful for the diagnosis of various autoimmune disorders including, but not limited to, rheumatoid arthritis, lupus erthyematosus, scleroderma, and dermatomyositis. Because the gene is expressed in cells of lymphoid origin, the natural gene product may be involved in immune functions. Therefore it may be also used as an agent for immunological disorders including arthritis, asthma, immune deficiency diseases such as AIDS, and leukemia. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:170 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1610 of SEQ ID NO:170, b is an integer of 15 to 1624, where both a and b correspond to the positions of nucleotide residues shown in SEQ ID NO:170, and where b is greater than or equal to a+14.

Features of Protein Encoded by Gene No: 161

This gene has homology to the tissue inhibitor of metalloproteinase 2. Such inhibitors are vital to the proper regulation of metalloproteins such as collagenases, which has implications for tissue regeneration and autoimmune disorders (See Genbank Accession No. P16368). When tested against Jurkat cell lines, supernatants removed from cells containing this gene activated the GAS (gamma activating sequence) promoter element. Thus, it is likely that this gene activates T-cells cells through the JAK-STAT signal transduction pathway. GAS is a promoter element found upstream of many genes which are involved in the Jak-STAT pathway. The Jak-STAT pathway is a large, signal transduction pathway involved in the differentiation and proliferation of cells. Therefore, activation of the Jak-STAT pathway, reflected by the binding of the GAS element, can be used to indicate proteins involved in the proliferation and differentiation of cells. In addition, this gene maps to chromosome 17, and therefore, may be used as a marker in linkage analysis for chromosome 17 (See Genbank Accession No. P16368).

This gene is expressed primarily in several types of cancers including osteoclastoma, chondrosarcoma, and rhabdomyosarcoma, and to a lesser extent, in non-malignant tissues including synovium, amygdala, testes, and placenta.

Therefore, polynucleotides and polypeptides of the invention are useful as reagents for differential identification of the tissue(s) or cell type(s) present in a biological sample and for diagnosis of diseases and conditions which include, but are not limited to, immune or integumentary disorders, particularly cancers of bone and cartilage, as well as various autoimmune disorders. Similarly, polypeptides and antibodies directed to these polypeptides are useful in providing immunological probes for differential identification of the tissue(s) or cell type(s). For a number of disorders of the above tissues or cells, particularly of the musculoskeletal system, expression of this gene at significantly higher or lower levels may be routinely detected in certain tissues or cell types (e.g., skeletal, integumentary, synovium, muscle, fibroids, reproductive, neural, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 409 as residues: Thr-24 to Thr-34.

The tissue distribution in various cancers, combined with the sequence homology to a collagenase inhibitor and the detected GAS biological activity, indicates that the protein product of this gene is useful for the detection of various autoimmune disorders such as rheumatoid arthritis, lupus, scleroderma, and dermatomyositis. Therefore it may be also used as an agent for immunological disorders including arthritis, asthma, immune deficiency diseases such as AIDS, and leukemia. The expression of this gene product would also suggest a role in the detection and treatment of disorders and conditions afflicting the skeletal system, in particular osteoporosis, bone cancer, as well as, connective tissue disorders (e.g. arthritis, trauma, tendonitis, chrondomalacia and inflammation), such as in the diagnosis or treatment of various autoimmune disorders such as rheumatoid arthritis, lupus, scleroderma, and dermatomyositis as well as dwarfism, spinal deformation, and specific joint abnormalities as well as chondrodysplasias (ie. spondyloepiphyseal dysplasia congenita, familial osteoarthritis, Atelosteogenesis type II, metaphyseal chondrodysplasia type Schmid). Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:171 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1989 of SEQ ID NO:171, b is an integer of 15 to 2003, where both a and b correspond to the positions of nucleotide residues shown in SEQ ID NO:171, and where b is greater than or equal to a+14.

Features of Protein Encoded by Gene No: 162

This gene is homologous to the mitochondrial ATP6 gene, and therefore is likely a homolog of this gene family (See Genbank Accession No. X76197).

This gene is expressed primarily in brain tissue.

Therefore, polynucleotides and polypeptides of the invention are useful as reagents for differential identification of the tissue(s) or cell type(s) present in a biological sample and for diagnosis of diseases and conditions which include, but are not limited to, neural disorders, including, but not limited to, neurodegenerative conditions, Down's syndrome, depression, Schizophrenia, and epilepsy. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues or cell types (e.g., neural, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in brain tissue indicates this gene is useful for diagnosis of various neurological disorders including, but not limited to, brain cancer. Additionally the gene product may be used as a target in the immunotherapy of cancer in the brain as well as for the diagnosis of metabolic disorders such as obesity, Tay-Sachs disease, phenylketonuria and Hurler's Syndrome. Similarly, the protein product of this gene is useful for the detection/treatment of neurodegenerative disease states, behavioural disorders, or inflammatory conditions which include, but are not limited to Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Moreover, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:172 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 772 of SEQ ID NO:172, b is an integer of 15 to 786, where both a and b correspond to the positions of nucleotide residues shown in SEQ ID NO:172, and where b is greater than or equal to a+14.

Features of Protein Encoded by Gene No: 163

The translation product of this gene was found to have homology to the MRS3 and 4 protein of *Saccharomyces cerevisiae* (See Genbank Accession No. gi|3996), which is known to suppress a splice defect in mitochondrial by possibly serving to modulate the cation-solute concentration in mitochondria. In specific embodiments, polypeptides of the invention comprise the following amino acid sequence: DEPCPPPAASCAPPSWRMELRTGSVG-SQAVARRMDGDSRDGGGGKDATGSEDY-ENLPTSASVSTHMTAGAMAGILEHS-VMYPVDSVKTRMQSLSPDPKAQYTSIYGALKKIMR TEASGGPCEASTS (SEQ ID NO:1076), RMELRTGSVG-SQAVARRMDGDSRDGGGGKDATGS (SEQ ID NO:1077), and/or PVDSVKTRMQSLSPDP-KAQYTSIYGAL (SEQ ID NO:1078). Polynucleotides encoding these polypeptides are also encompassed by the invention. The gene encoding the disclosed cDNA is believed to reside on chromosome 8. Accordingly, polynucleotides related to this invention are useful as a marker in linkage analysis for chromosome 8.

This gene is expressed primarily in placenta, neutrophils, and microvascular endothelial cells, and to a lesser extent, brain, prostate, spleen, thymus, and bone.

Therefore, polynucleotides and polypeptides of the invention are useful as reagents for differential identification of the tissue(s) or cell type(s) present in a biological sample and for diagnosis of diseases and conditions which include, but are not limited to, immune, vascular, or reproductive disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, vascular, endothelial, reproductive, neural, skeletal, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Features of Protein Encoded by Gene No: 164

The gene encoding the disclosed cDNA is believed to reside on chromosome 7. Accordingly, polynucleotides related to this invention are useful as a marker in linkage analysis for chromosome 7.

This gene is expressed primarily in neutrophils, monocytes, bone marrow, and fetal liver.

Therefore, polynucleotides and polypeptides of the invention are useful as reagents for differential identification of the tissue(s) or cell type(s) present in a biological sample and for diagnosis of diseases and conditions which include, but are not limited to, immune system or hematopoietic disorders including, but not limited to, autoimmune disorders such as lupus, leukemia and immunodeficiency disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, hepatic, developmental, and cancerous and wounded tissues) or bodily fluids (e.g., lymph, serum, amniotic fluid, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in various immune system tissues indicates that the protein product of this gene is useful for the diagnosis of various immunological disorders such as Hodgkin's lymphoma, arthritis, asthma, immune deficiency diseases such as AIDS, and leukemia. Moreover, the protein product of this gene is useful for the treatment and diagnosis of hematdpoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:174 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1355 of SEQ ID NO:174, b is an integer of 15 to 1369, where both a and b correspond to the positions of nucleotide residues shown in SEQ ID NO:174, and where b is greater than or equal to a+14.

Features of Protein Encoded by Gene No: 165

The translation product of this gene shares sequence homology with dystrophin which is thought to be defective in both Duchene and Becker Muscular Dystrophy. Preferred polypeptide fragments comprise the following amino acid sequence: MKLLGECSSSIDSVKRLEHKL-KEEEESLPGFVNLHSTETQTAGVIDRWELLQAQ ALSKELRMKQNLQKWQQFNSDLNSIWAWLGDTE EELEQLQRLELSTDIQTIELQIKKLKELQKAVD HRKAIILSINLCSPEFFQADSKESRDLQDRLXQ MNGRWDRVCSLLEEWRGLLQDALMQCQG-FHEMSHGLLLMLENIDRRKNEIVPID-SNLDAEILQDHHKQLMQIKHELLESQLR-VASLQDMSCQLLVNAEGTDCLEAKEKVHVIGNRLK LLLKEVSRHIKELEKLLDVSSSQQDLSSWSSADEL DTSGSVSPXSGRSTPNRQKTPRGKCSLSQPGPSVS SPHSRSTKGGSDSSLSEPXPGRSGRGFLFRVLRAA LPLQLLLLLIGLACLVPMSEEDYSCALSNNFARS FHPMLRYTNGPPPL (SEQ ID NO:1079), MKLLGEC-SSSIDSVKRLEHKLKEEEESLPGFVNLH-STETQTAGVIDRWELLQAQALSKEL-RMKQNLQKWQQFNSDLNSIWAWLGDTEEELEQLQ RLELSTDIQTEELQIK (SEQ ID NO:1080), KLKELQKAVDHRKAIILSIN-LCSPEFTQADSKESRDLQDRLXQMNGRW-DRVCSLLEEWRGLLQDALMQCQGFHEM-SHGLLLMLENIDRRKNEIVPIDSNLDAEILQDHHKQL MQIKHELLESQLRVASLQDMSCQL (SEQ ID NO:1081), QDMSCQLLVNAEGTDCLEAKEKVHVIGN-RLKLLLKEVSRHIKELEKLLD-VSSSQQDLSSWSSADELDTSGSVSPXS-GRSTPNRQKTPRGKCSLSQPGPSVSSPHS (SEQ ID NO:1082), DSSLSEPXPGRSGRGFLFRVLRAAL-PLQLLLLLIGLACLVPMSEEDYSCAL-SNNFARSFHPMLRYTNGPPPL (SEQ ID NO:1083), QRFLPPGSCXLIRGPQCPRVTDPT-TGQSLDDSRFQIQQTENIIRSKTPTGPELDTSYKGY (SEQ ID NO:1084), SISASRLESIGTISFFLLSMFSSIR-SKPWLISWKPWHCIRASCSRPRHSSSRE-HTRSQRPFICXKRSCRSRLSLLSAWVNS-GLQRLMERMMALRWSTAFWSSLSFLIWSSMVWMS VLSSRRWSCSNSSSVSPSQAQMLFKSELNCCHFW RFCFILNSLLNAWAWRSSHRSITPAVWVSVLCRL TKPGRLSSSSFSLCSSLFTESILLLHSPSSFM (SEQ ID NO:1085), TAFWSSLSFLIWSSMVWMSVLSSRRWSC-SNSSSVS (SEQ ID NO:1086), LLNAWAWRSSHRSIT-PAVWVSVLCRL (SEQ ID NO:1087), LARHVLQRGY-SELGFQQLMLYLHKLFVMVLKYLCIKVRINRDNFIF PSVNVLQHKKQTMAHFETLAL-HQGLQQAPPLLQQRA HSVPAPMXQAILQVPAL-LAVSLGELRAAEIDGEDDG FAVVHSFLEL-LELFDLELDGLDVSAEFQTLELFQLL LRVPQPGPDAVQV (SEQ ID NO:1088), YSELGFQQLM-LYLHKLFVMVLKYLCIKV (SEQ ID NO:1089), AMVC-FLCWRTLTEGK (SEQ ID NO:1091), and/or VHSFLEL-LELFDLELDGLDVSAEFQTLEL (SEQ ID NO:1090). Also preferred are polynucleotide fragments encoding these polypeptide fragments. Furthermore, this gene maps to chromosome 6, and therefore, may be used as a marker in linkage analysis for chromosome 6 (See Genbank Accession No. N62896).

This gene is expressed in numerous tissues including the heart, kidney, and brain.

Therefore, polynucleotides and polypeptides of the invention are useful as reagents for differential identification of the tissue(s) or cell type(s) present in a biological sample and for diagnosis of diseases and conditions which include, but are not limited to, musculoskeletal disorders including Muscular Dystrophy and cardiovascular diseases. Similarly, polypeptides and antibodies directed to these polypeptides are useful in providing immunological probes for differential identification of the tissue(s) or cell type(s). For a number of disorders of the above tissues or cells, particularly of the muscle tissues, expression of this gene at significantly higher or lower levels may be routinely detected in certain tissues or cell types (e.g., muscle, heart, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in heart, combined with the homology to the human dystrophin gene indicates that the protein product of this gene is useful for the diagnosis and treatment of Muscular Dystrophy and other muscle disorders, particularly musculodegenerative conditions. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:175 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2365 of SEQ ID NO:175, b is an integer of 15 to 2379, where both a and b correspond to the positions of nucleotide residues shown in SEQ ID NO:175, and where b is greater than or equal to a+14.

Features of Protein Encoded by Gene No: 166

In specific embodiments, polypeptides of the invention comprise the following amino acid sequence: GAGVGTAMPRVPQSAGGAVTWWGVGLSQPSSVQGGARPGTVPGTPGPLPGLSPAPPPQHPPPLPKLFLLCLSXSLPQDFSLLLCLSLDPCPSSTSDL (SEQ ID NO:1092), GTVPGTPGPLPGLSPAPPPQHPPPLPKLFL (SEQ ID NO:1093), APSRCRRSVVQVPYSAFSSCSWTPTALRRGVLLYAGLSTSSASKAQGWHCLGLEYPSGAIMEVRGRGGDRYAQGPSKCWRGCXLVGSGSVTAILCPGWGKAWDSARHPRTPSRLVSCSTASTPPTPAQAVSPLPLXFPAPGLLSSPLPLLGPLPFLYL (SEQ ID NO:1094), TALRRGVLLYAGLSTSSASKAQGWHCLGLEYPSGAIM (SEQ ID NO:1095), AILCPGWGKAWDSARHPRTPSRLVSCSTASTPP (SEQ ID NO:1096), PPVFMASHRPXGMEPGEWRFVLVHIAFXCAWDLVCEHVSVCSQVRGRGRAGVQGEAEEKREVLGQGXREAEEKQLGQGWGVLRRWSRRQAWKGSWGAWHCPRPCPTLDRGWL (SEQ ID NO:1097), and/or HVSVCSQVRGRGRAGVQGEAEEKREVLGQ (SEQ ID NO:1098). Polynucleotides encoding these polypeptides are also encompassed by the invention.

This gene is expressed primarily in human cerebellum.

Therefore, polynucleotides and polypeptides of the invention are useful as reagents for differential identification of the tissue(s) or cell type(s) present in a biological sample and for diagnosis of diseases and conditions which include, but are not limited to, diseases of the central nervous system, including Alzheimer's Disease, Parkinson's Disease, ALS, and mental illnesses. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues or cell types (e.g., neural, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 414 as residues: Pro-20 to Gly-26, Leu-37 to Pro-42, His-57 to Gly-63.

The tissue distribution in human cerebellum indicates that the protein products of this gene are useful for the treatment/diagnosis of diseases of the central nervous system and may protect or enhance survival of neuronal cells by slowing progression of neurodegenerative diseases. Moreover, the protein product of this gene is useful for the detection/treatment of neurodegenerative disease states, behavioural disorders, or inflammatory conditions which include, but are not limited to Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Moreover, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:176 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1334 of SEQ ID NO:176, b is an integer of 15 to 1348, where both a and b correspond to the positions of nucleotide residues shown in SEQ ID NO:176, and where b is greater than or equal to a+14.

Features of Protein Encoded by Gene No: 167

Preferred polypeptides encoded by this gene comprise the following amino acid sequence: MKLLICGNYLAPSHSESSRRCCLLCFYPLCLEINFGMKV-FLSMPFLVLFQSLIQED (SEQ ID NO:1099). Polynucleotides encoding such polypeptides are also provided. The gene encoding the disclosed cDNA is believed to reside on chromosome 15. Accordingly, polynucleotides related to this invention are useful as a marker in linkage analysis for chromosome 15.

This gene is expressed primarily in human testes tumor, and to a lesser extent, in normal human testes.

Therefore, polynucleotides and polypeptides of the invention are useful as reagents for differential identification of the tissue(s) or cell type(s) present in a biological sample and for diagnosis of diseases and conditions which include, but are not limited to, diseases of the testes, particularly cancer, and other reproductive disorders. Similarly, polypeptides and antibodies directed to these polypeptides are useful in providing immunological probes for differential identification of the tissue(s) or cell type(s). For a number of disorders of the above tissues or cells, particularly of the male reproductive tissues, expression of this gene at significantly higher or lower levels may be routinely detected in certain tissues or cell types (e.g., reproductive, testicular, and cancerous and wounded tissues) or bodily fluids (e.g., lymph, serum, seminal fluid, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in human testicular tissue indicates that the protein products of this gene are useful for the treatment/diagnosis of reproductive diseases including cancers. Moreove, the protein may possibly have utility as a contraceptive or may be used to ameliorate disorders related to aberrant male secondary characteristics (e.g. hair, etc.). Protein, as well as, antibodies directed against the protein may, show utility as a tumor marker and/or immunotherapy targets for the above listed tissues.

Many polynucleotide sequences, such as EST sequences, are publicly available and accessible through sequence databases. Some of these sequences are related to SEQ ID NO:177 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1488 of SEQ ID NO:177, b is an integer of 15 to 1502, where both a and b correspond to the positions of nucleotide residues shown in SEQ ID NO:177, and where b is greater than or equal to a+14.

Features of Protein Encoded by Gene No: 168

The translation product of this gene was found to have homology to the gar2 gene product of *Schizosaccharomyces pombe*, which is thought to be involved in protein metabolism (See Genbank Accession No. gi|663262). In specific embodiments, polypeptides of the invention comprise the following amino acid sequence: FSSPQGLKFRSKSSLA-NYLHKNGETSLKPEDFDFTVLSKRGIKSRYKDCS (SEQ ID NO:1100), ELLCYICWKNTGLFSFFLSVFRGM-VSSVKSFLVGEQLLSISEPRFKMSVCKC-SFLSTTSTFVPISSDSKKVSSYFSLCS-ESLAEQNLFMMPEVFCSEQKFDPELNDLSFHFFRLF SSLVTLRVSPHAPASEMQTVLS (SEQ ID NO:1101), and/ or TFVPISSDSKKVSSYFSLCSESLAEQNLFMMPEVFC (SEQ ID NO:1102). Polynucleotides encoding these polypeptides are also encompassed by the invention. The gene encoding the disclosed cDNA is believed to reside on chromosome 3. Accordingly, polynucleotides related to this invention are useful as a marker in linkage analysis for chromosome 3.

This gene is expressed primarily in fetal liver.

Therefore, polynucleotides and polypeptides of the invention are useful as reagents for differential identification of the tissue(s) or cell type(s) present in a biological sample and for diagnosis of diseases and conditions which include, but are not limited to, hepatic disorders, in addition to conditions affecting hematopoietic development and metabolic diseases. Similarly, polypeptides and antibodies directed to these polypeptides are useful in providing immunological probes for differential identification of the tissue(s) or cell type(s). For a number of disorders of the above tissues or cells, particularly of the hepatic system, and fetal hematopoietic system, expression of this gene at significantly higher or lower levels may be routinely detected in certain tissues or cell types (e.g., hepatic, metabolic, hematopoietic, and cancerous and wounded tissues) or bodily fluids (e.g., lymph, serum, bile, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 416 as residues: His-7 to Trp-17, Leu-19 to Lys-27, Pro-33 to Gly-44, Lys-68 to Gly-74, Lys-85 to Cys-95.

The tissue distribution in liver, combined with the homology to the gar2 protein, indicates that the protein products of this gene are useful for the treatment/diagnosis of diseases of the developing liver and hematopoietic system, and act as a growth differentation factor for hematopoietic stem cells. Moreover, the protein product of this gene is useful for the detection and treatment of liver disorders and cancers (e.g. hepatoblastoma, jaundice, hepatitis, liver metabolic diseases and conditions that are attributable to the differentiation of hepatocyte progenitor cells). In addition, the expression in fetus would suggest a useful role for the protein product in developmental abnormalities, fetal deficiencies, pre-natal disorders, and various would-healing models and/or tissue trauma. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:178 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1623 of SEQ ID NO:178, b is an integer of 15 to 1637, where both a and b correspond to the positions of nucleotide residues shown in SEQ ID NO:178, and where b is greater than or equal to a+14.

Features of Protein Encoded by Gene No: 169

The polypeptide encoded by this gene is believed to be a membrane bound receptor. Additionally, the extracellular domain of this polypeptide is expected to consist of the following amino acid sequence: RILLVKYSANEENKY-DYLPTITVNVCSELVKLVFCVLVSFC-VIKKDHQSRNLKYASWKEFSDFMKWSI-PAFLYFLDNLIVFYVLSYLQPAMAVIFSNFSIITTALLF RIVLKXRLNWIQWASLLTLFLSIVALT-AGTKTLQHNLAG RGFHHDAFFSPSNSCLL-FRNECPRKDNCTAKEWTFPEAK WNTTARVFSHIRL-GMGHVLIIVQCFISSMANIYNEKILK EGNQLTEXIFIQNSKLYFFGIL-FNGLTLGLQRSNRDQIK NCGFFYGHS (SEQ ID NO:1103), TVNVCSELVKLVFCVLVSFCVIKKDHQSRN (SEQ ID NO:1104), LIVFYVLSYLQPAMAVIFSNFSIIT-TALLFR (SEQ ID NO:1105), FFSPSNSCLL-FRNECPRKDNCTAKEWT (SEQ ID NO:1106), and/or YFFGILFNGLTLGLQRSNRDQIKNCGFF (SEQ ID NO:1107). Thus, preferred polypeptides encoded by this gene comprise the extracellular domain, as shown above. It will be recognized, however, that deletions of either end of the extracellular domain up to the first cysteine from the N-terminus and the first cysteine of the C-terminus, is expected to retain the biological functions of the full-length extracellular domain, because the cysteines are thought to be responsible for providing secondary structure to the molecule. Thus, deletions of one or more amino acids from either end (or both ends) of the extracellular domain are contemplated. Of course, further deletions including the cysteines are also contemplated as useful, as such polypeptides is expected to have immunological properties such as the ability to evoke an immune response. Polynucleotides encoding all of the foregoing polypeptides are provided.

This gene is expressed primarily in human osteoclastoma, and to a lesser extent, in hippocampus and chondrosarcoma.

Therefore, polynucleotides and polypeptides of the invention are useful as reagents for differential identification of the tissue(s) or cell type(s) present in a biological sample and for diagnosis of diseases and conditions which include, but are not limited to, skeletal or connective tissue disorders, particularly cancers. Similarly, polypeptides and antibodies directed to these polypeptides are useful in providing immunological probes for differential identification of the tissue(s) or cell type(s). For a number of disorders of the above tissues or cells, particularly of the skeletal system, expression of this gene at significantly higher or lower levels may be routinely detected in certain tissues or cell types (e.g., skeletal, neural, immune, connective, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 417 as residues: Met-1 to Cys-6, Ala-41 to Tyr-49, Lys-76 to Lys-84.

The tissue distribution in osteoclastoma and chondrosarcoma indicates that the protein products of this gene are useful for the diagnosis of cancers of the bone and connective tissues, and may act as growth factors for cells involved in bone or connective tissue growth. Moreover, this gene product may show utility in the detection and treatment of disorders and conditions affecting the skeletal system, in particular osteoporosis, bone cancer, as well as, disorders afflicting connective tissues (e.g. arthritis, trauma, tendonitis, chrondomalacia and inflammation), such as in the diagnosis or treatment of various autoimmune disorders such as rheumatoid arthritis, lupus, scleroderma, and dermatomyositis, as well as dwarfism, spinal deformation, and specific joint abnormalities as well as chondrodysplasias (ie. spondyloepiphyseal dysplasia congenita, familial osteoarthritis, Atelosteogenesis type II, metaphyseal chondrodysplasia type Schmid). Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:179 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2897 of SEQ ID NO:179, b is an integer of 15 to 2911, where both a and b correspond to the positions of nucleotide residues shown in SEQ ID NO:179, and where b is greater than or equal to a+14.

Features of Protein Encoded by Gene No: 170

Preferred polypeptides encoded by this gene comprising the following amino acid sequence: NSVPNLQTLAVL-TEAIGPEPAIPRXPREPPVATSTPATP-SAGPQPLPTGTVLVPGGPAPP-CLGEAWALLLPPCRPSLTSCFWSPRPSPWKETGV (SEQ ID NO:1108), VTAGRVGGGGPMPPQGKVGQD-PQGPARSRLGGAGAR-QRVWQVWTWQQAAPGGXGGWRALGQWPQ (SEQ ID NO:1109), STPATPSAGPQPLPTGTVLVPGGPAP (SEQ ID NO:1110), and/or QDPQGPARSRLGGAGARQR (SEQ ID NO:1111). Polynucleotides encoding such polypeptides are also provided herein.

This gene is expressed primarily in hematopoietic progenitor cells.

Therefore, polynucleotides and polypeptides of the invention are useful as reagents for differential identification of the tissue(s) or cell type(s) present in a biological sample and for diagnosis of diseases and conditions which include, but are not limited to, hematopoietic or immune disorders, particularly cancer and autoimmune disorders. Similarly, polypeptides and antibodies directed to these polypeptides are useful in providing immunological probes for differential identification of the tissue(s) or cell type(s). For a number of disorders of the above tissues or cells, particularly of the blood/circulatory system, expression of this gene at significantly higher or lower levels may be routinely detected in certain tissues or cell types (e.g., hematopoietic, immune, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 418 as residues: Gln-4 to His-10, Pro-25 to His-32.

The tissue distribution in hematopoietic progenitor cells indicates that the protein products of this gene are useful for diagnosis of diseases involving growth differentation of hematopoietic cells. Moreover, the protein product of this gene is useful for the treatment and diagnosis of hematopoietic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:180 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a-b, where a is any integer between 1 to 505 of SEQ ID NO:180, b is an integer of 15 to 519, where both a and b correspond to the positions of nucleotide residues shown in SEQ ID NO:180, and where b is greater than or equal to a+14.

Features of Protein Encoded by Gene No: 171

Preferred polypeptides encoded by this gene comprise the following amino acid sequences: ALQLAFYPDAVEE-WLEENVHPSLQRLQXLLQDLSEVSAPP (SEQ ID NO:1112), CHPPALAGTLLRTPEGRAHARGLL-LEAGGA (SEQ ID NO:1113), GSSSTRSWFSTSSPQR-SASWHSGAPSCRSWRLPCSWLSTRMP-WRSGWRKTCTPACSGCK (SEQ ID NO: 1114), ASTLQPSLSPSSPPLXPPVETAVXSRAL-RREGAGSFPGSNILALVTQVSLHLRSS-VDALLEGNRYVTGWFSPYHRQRKLIHPV (SEQ ID NO:1115), PLGPEKAGLAXPLVXHAAR-PCPSTSLQSQCSPSLXXEPXXPPRSX-VISGGFDEDVKAKVENLLGISSLEKTD-PVRQAPCSPPCPLLPLPFXRPWRQLFSAGLSAGRGPA PSLAATSLPLSHKSASICAALWM-RCWRATGMSLAGSA PTTASGSSSTRSWFSTSSPQR-SASWHSGAPSCRSWRL PCSWLSTRMPWRSGWRK-TCTPACSGCKLCCRTSARCL PPRCHPPALAGTLLRTPEGRAHARGLL-LEAGGALXXX XAWASCPLAQQCLAHfTQFLRALG-SPWGRD (SEQ ID NO:1116), FQEDLMKMLKRKWRTF-SGFPAWKKRTLLGKHPAALPVPFFPSPSPARGDSCXQ QGSPQGGGRLLPWQQHPCPCHTSQPP-SAQLCGCAAGG QQVCHWLVQPLPPPAEAHPPGHG-SAHPARSAQPPGTV EHPRAGAGGCPAAGFLPGCRG-GVAGGKRAPQPAAAAX SAAGPQRGVCPPAATHQPWQGRCSGPLR-GELMPGGSC WRLGGLCXXXWPGQYGPRGRRAL-WPSSVLPTLSS (SEQ ID NO:1117), ALPSGVLSNV-PARAGGWQRGGRHLAEVLQQSLQPLQAGVHVFLQP LLHGIRVESQLQGSLQLLHEGAPLCQEAERCGLDV LNHDRVDELPLAVVGAEPASDIPVALQQRIHRAAQ MEADLCDKGKDVAAREGAGPLPAESPAENSCLHGR XKGRGRRGQGGLQGACLTGSVFSRLEIPRRFSTFA LTSSSNPPEITXXRGGXXGSXXREGLHWDCRLVLG HGRAAWXTNGQANPAFSGPKG (SEQ ID NO:1118), RQLFSAGLSAGRGPAPSLAATSLPLSHKS (SEQ ID NO:1119), ELPLAVVGAEPASDIPVALQQRIHRAAQ (SEQ ID NO:1120), and/or QPPGTVEHPRAGAGGC-PAAGFLPGCRG (SEQ ID NO:1121). Polynucleotides encoding such polypeptides are also provided. The protein product of this gene shares sequence homology with metallothionines. Thus, polypeptides encoded by this gene are expected to have metallothionine activity. Furthermore, such activities are known in the art and described elsewhere herein.

This gene is expressed primarily in kidney cortex.

Therefore, polynucleotides and polypeptides of the invention are useful as reagents for differential identification of the tissue(s) or cell type(s) present in a biological sample and for diagnosis of diseases and conditions which include, but are not limited to, renal disorders, particularly diseases of the kidney including cancer and renal dysfunction. Similarly, polypeptides and antibodies directed to these polypeptides are useful in providing immunological probes for differential identification of the tissue(s) or cell type(s). For a number of disorders of the above tissues or cells, particularly of the renal system, expression of this gene at significantly higher or lower levels may be routinely detected in certain tissues or cell types (e.g., renal, urogenital, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 419 as residues: Ser-47 to Gln-52.

The tissue distribution in kidney cortex indicates that the protein product of this gene is useful for the treatment/diagnosis of diseases of the kidney, including kidney failure. Moreover, this gene or gene product could be used in the treatment and/or detection of kidney diseases including nephritis, renal tubular acidosis, proteinuria, pyuria, edema, pyelonephritis, hydronephritis, nephrotic syndrome, crush syndrome, glomerulonephritis, hematuria, renal colic and kidney stones, in addition to Wilms Tumor Disease, and congenital kidney abnormalities such as horseshoe kidney, polycystic kidney, and Falconi's syndrome. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:181 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a-b, where a is any integer between 1 to 954 of SEQ ID NO:181, b is an integer of 15 to 968, where both a and b correspond to the positions of nucleotide residues shown in SEQ ID NO:181, and where b is greater than or equal to a+14.

Features of Protein Encoded by Gene No: 172

In specific embodiments, polypeptides of the invention comprise the following amino acid sequence: SVFERTNE-FRDVLWSSI (SEQ ID NO:1122), GVVQVTFMSSVS-RVTWGCQPSICPGAPPAAALAGGLRLL-FERELFGLPVSSPLICSFLEHHPRTSPPPSDCELLEGRS CVLLFIFLSPEPCTDPGMW (SEQ ID NO:1123), SKQIH-SFVHSFIHLFNTHLLSTYHIPGSVQGS-GDRKMNRRTQLLPSRSSQSDGGGDVLG-WCSKKEQIRGEETGRPNSSLSKRSLRPPARAAAGG APGQMLG (SEQ ID NO:1124), VTWGCQPSICPGAP-PAAALAGGLRLLFE (SEQ ID NO:1125), and/or EQIR-GEETGRPNSSLSKRSLRPP (SEQ ID NO:1126). Polynucleotides encoding these polypeptides are also encompassed by the invention.

This gene is expressed primarily in 12 week old early stage human.

Therefore, polynucleotides and polypeptides of the invention are useful as reagents for differential identification of the tissue(s) or cell type(s) present in a biological sample and for diagnosis of diseases and conditions which include, but are not limited to, developmental abnormalities. Similarly, polypeptides and antibodies directed to these polypeptides are useful in providing immunological probes for differential identification of the tissue(s) or cell type(s). For a number of disorders of the above tissues or cells, particularly of the developing embryo, expression of this gene at significantly higher or lower levels may be routinely detected in certain tissues or cell types (e.g., developmental, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 420 as residues: Gln-31 to Thr-43, Gly-51 to Ser-58, Pro-65 to Pro-72.

The tissue distribution in embryonic tissue indicates that the protein product of this gene is useful for treatment/ diagnosis of developmental conditions. The gene may be involved in vital organ development in the early stage, especially hematopoiesis, the cardiovascular system, and neural development. Moreover, expression within embryonic tissue indicates that this protein may play a role in the regulation of cellular division, and may show utility in the diagnosis and treatment of cancer and other proliferative disorders. Similarly, developmental tissues rely on decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:182 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1114 of SEQ ID NO:182, b is an integer of 15 to 1128, where both a and b correspond to the positions of nucleotide residues shown in SEQ ID NO:182, and where b is greater than or equal to a+14.

Features of Protein Encoded by Gene No: 173

The translation product of this gene shares sequence homology with TGN38, an integral membrane protein previously shown to be predominantly localized to the trans-Golgi network (TGN) of cells. The gene encoding the disclosed cDNA is believed to reside on chromosome 5. Accordingly, polynucleotides related to this invention are useful as a marker in linkage analysis for chromosome 5.

This gene is expressed primarily in developing embryo, and to a lesser extent, in cancer tissues including lymphoma, endometrial, prostate and colon.

Therefore, polynucleotides and polypeptides of the invention are useful as reagents for differential identification of the tissue(s) or cell type(s) present in a biological sample and for diagnosis of diseases and conditions which include, but are not limited to, developmental abnormalities and cancer. Similarly, polypeptides and antibodies directed to these polypeptides are useful in providing immunological probes for differential identification of the tissue(s) or cell type(s). For a number of disorders of the above tissues or cells, particularly of the developing fetus, expression of this gene at significantly higher or lower levels may be routinely detected in certain tissues or cell types (e.g., developmental, reproductive, immune, gastrointestinal, and cancerous and wounded tissues) or bodily fluids (e.g., lymph, amniotic fluid, seminal fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 421 as residues: His-65 to Ser-72, Pro-82 to Gly-91, Pro-98 to Glu-118, Ser-126 to Gly-166, Pro-180 to Asp-188, Tyr-209 to Lys-214, Gln-220 to Leu-228.

The tissue distribution in the embryo, combined with the homology to an integral membrane protein indicates that the protein product of this gene is useful for the diagnosis of cancers and developmental abnormalities where aberrant expression relates to an abnormality. Expression within embryonic tissue and other cellular sources marked by proliferating cells indicates that this protein may play a role in the regulation of cellular division, and may show utility in the diagnosis and treatment of cancer and other proliferative disorders. Similarly, developmental tissues rely on decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:183 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2262 of SEQ ID NO:183, b is an integer of 15 to 2276, where both a and b correspond to the positions of nucleotide residues shown in SEQ ID NO:183, and where b is greater than or equal to a+14.

Features of Protein Encoded by Gene No: 174

The translation product of this gene shares sequence homology with a dnaJ heat shock protein from *E. coli* which is allelic to sec63, a gene that affects transit of nascent secretory proteins across the endoplasmic reticulum in yeast. In specific embodiments, polypeptides of the invention comprise the following amino acid sequence: QWEHLLLL-PHLLRGAHRDPGDILPLAPRSECRAN-SIKEYQKSIWKVYVVRLRLLKPQPNI-IPTVKKIVLLAGWALFLFLAYKVSKTDREYQEYNPY EVLNLDPGATVAEIKKQYRLLSLKYHPDKGGDEV (SEQ ID NO:1127), EERGGGGAMAG QQFQYDDS-GNTFFYFLTSFVGLFVIPATYYLWPRDQN AEQIRLKNIRKVYGRC(SEQ ID NO:1128), RLYTGCV-IFDLVSNRALSFRCMLCCNSCHSASSSLFC FSSCSLS-ESLSLPSSFSLWESLLVSSSSESLPLSETSSSSSFTAAS FPTTPFACFCFCCFDCGNSTGVGFFFKGFFFFDLAV FLGPLLFCCHPPFVLFLLVSPCPSSAGCSSAAQ MDCS- FSNTSAIVCLVNLTNTVTKDPTVMLLLSSSSNT CDFISMVTYGKLPRTAITSSYFSSSRKCSRV (SEQ ID NO:1129), YQKSIWKVYVVRLRLLKPQPNIIPTVK-KIVLLAGW (SEQ ID NO:1130), and/or CHPPFV-LFLLVSPCPSSAGCSSAAQMDCSFSNTSA (SEQ ID NO:1131). Polynucleotides encoding these polypeptides are also encompassed by the invention.

This gene is expressed primarily in Hodgkin's lymphoma, and to a lesser extent, in testes.

Therefore, polynucleotides and polypeptides of the invention are useful as reagents for differential identification of the tissue(s) or cell type(s) present in a biological sample and for diagnosis of diseases and conditions which include, but are not limited to, immune or hematopoietic disorders, particularly cancer. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, reproductive, testicular, and cancerous and wounded tissues) or bodily fluids (e.g., lymph, seminal fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 422 as residues: Val-37 to Pro-49, His-76 to Asp-82, Thr-97 to Trp-105, Arg-158 to Asp-165, Glu-199 to Asp-214, Asn-229 to Pro-236, Thr-261 to Gln-266, Arg-292 to Glu-298, Glu-335 to Lys-351, Glu-372 to Glu-377, Leu-398 to Asn-405, Glu-437 to Pro-480, Gln-487 to Gln-495, Lys-507 to Ala-555, Ser-563 to Arg-569, Pro-588 to Glu-593, Lys-618 to Val-623, Pro-630 to Asn-635, Ser-644 to Gly-649, Lys-664 to Trp-673, Gly-679 to Phe-689, Asp-691 to Asp-704.

The tissue distribution in Hodgkin's lymphoma, combined with the homology to dnaJ and sec63 indicates that the protein product of this gene is useful as a diagnostic for cancer, that the protein may be useful in regulating gene expression levels, and that it is essential for normal protein metabolism. Therefore, protein products of this gene may show utility as an anticancer agent, or even serve to protect from viral or bacterial infections, based upon its homologous function as a protein chaperone. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:184 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 3360 of SEQ ID NO:184, b is an integer of 15 to 3374, where both a and b correspond to the positions of nucleotide residues shown in SEQ ID NO:184, and where b is greater than or equal to a+14.

Features of Protein Encoded by Gene No: 175

The gene encoding the disclosed cDNA is believed to reside on chromosome 5. Accordingly, polynucleotides related to this invention are useful as a marker in linkage analysis for chromosome 5. Contact of cells with supernatant expressing the product of this gene has been shown to increase the permeability of the plasma membrane of chondrocytes to calcium. Thus it is likely that the product of this gene is involved in a signal transduction pathway that is initiated when the product binds a receptor on the surface of the plasma membrane of both chondrocytes, in addition to other cell-lines or tissue cell types. Thus, polynucleotides and polypeptides have uses which include, but are not limited to, activating chondrocytes.

This gene is expressed primarily in endothelial cells, and to a lesser extent, in bone marrow stromal cells.

Therefore, polynucleotides and polypeptides of the invention are useful as reagents for differential identification of the tissue(s) or cell type(s) present in a biological sample and for diagnosis of diseases and conditions which include, but are not limited to, immune, hematopoietic, endothelial, or vascular disorders, such as diseases involving angiogenic abnormalities including diabetic retinopathy, macular degeneration, and other diseases including arterioscerosis and cancer. Similarly, polypeptides and antibodies directed to these polypeptides are useful in providing immunological probes for differential identification of the tissue(s) or cell type(s). For a number of disorders of the above tissues or cells, particularly of the vascular system, expression of this gene at significantly higher or lower levels may be routinely detected in certain tissues or cell types (e.g., immune, hematopoietic, endothelial, vascular, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in endothelial cells indicates that the protein products of this gene are useful for treating diseases where an increase or decrease in angiogenesis is indicated and as a factor in the wound healing process. In addition, the protein product of this gene may show utility in the treatment, detection, and/or prevention of a variety of vascular disorders, which include, but are not limited to microvascular disease, embolism, thrombosis, atherosclerosis, aneurysm, or stroke. Moreover, the protein product of this gene is useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:185 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1323 of SEQ ID NO:185, b is an integer of 15 to 1337, where both a and b correspond to the positions of nucleotide residues shown in SEQ ID NO:185, and where b is greater than or equal to a+14.

Features of Protein Encoded by Gene No: 176

The translation product of this gene shares sequence homology with both the RIC and MAT8 proteins (mouse), which are thought to be important in regulating chloride conductance in cells by modulating the response mediated by cAMP and protein kinase C to extracellular signals. In specific embodiments, polypeptides of the invention comprise the following amino acid sequence: GTSLDAAATAASLSPRGCRLRTPSSD (SEQ ID NO:1132), QIQRHTRAPKQLIPLMTPRRSLRDH-PQAQTSRQTPRPSSHLVFMRMTPSSM-MNTPSGNGGCWSQL-CCSSQASSSSPVASAGSCPGYAGIIAGESIRNRS (SEQ ID NO:1133), PRRSLRDHPQAQTSRQTPRPSSHLVFM (SEQ ID NO:1134), THPPETGAVGRSCAVHHRHHH-PHQWQVQAAVPVMPESLQVSPSETGAD-NXLGTRRPSPLPAHRAQPPASPRRAW-PEREDTDDEAGARAAGPSLLPPPTLPAPEGYLAPWG LSLKLSPLLRQKVKHCGLC (SEQ ID NO:1135), PESLQVSPSETGADNXLGTRRPSPLPAHRAQPPASP (SEQ ID NO:1136), GTAPKAPGSLQGRAGLGEVGDS-DRQPWLQLHHLCLPSLARLFEGMQEAGH-GELAGGLVFGCPAGCQLLFLMDSPAMIPA (SEQ ID NO:1137), GEVGDSDRQPWLQLHHLCLPSLARLFEG-MQEAGH (SEQ ID NO:1138), GSGGLSGRLCLGM-VSQRASWCHQWDELLWCSCVSLDLSLEAHPFLP VAGSGSGVVVFHQQARLGLERWAGVLCR-LHLGLVSGPECP (SEQ ID NO:1139), and/or QWDELL-WCSCVSLDLSLEAHPFLPVAGSGSGVVVFHQQARL (SEQ ID NO:1140). Polynucleotides encoding these polypeptides are also encompassed by the invention. The gene encoding the disclosed cDNA is believed to reside on chromosome 19. Accordingly, polynucleotides related to this invention are useful as a marker in linkage analysis for chromosome 19.

This gene is expressed primarily in amniotic cells and hematopoeitic cells including macrophages, neutrophils, T cells, TNF induced aortic endothelium, and to a lesser extent in testes, TNF induced epithelial cells, and smooth muscle.

Therefore, polynucleotides and polypeptides of the invention are useful as reagents for differential identification of the tissue(s) or cell type(s) present in a biological sample and for diagnosis of diseases and conditions which include, but are not limited to, immune or hematopoietic disorders, particularly inflammatory responses mediated by T cells, macrophages, and/or neutrophils, particularly those involving TNF, and also cancer. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, developmental, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 424 as residues: Thr-19 to Ala-33, Leu-54 to Asp-82, Pro-89 to Ala-97, Pro-100 to Lys-125, Ser-127 to Phe-135, Gly-164 to Leu-169, Cys-173 to Arg-178.

The tissue distribution in hematopoietic cells, combined with the homology to the RIC and mat-8 genes, indicates that the protein product of this gene is useful for modifying inflammatory responses to cytokines such as TNF, and thus modifying the duration and/or severity of inflammation. Polynucleotides and polypeptides derived from this gene are thought to be useful in the diagnosis and treatment of cancer. The protein product of this gene is useful for the treatment and diagnosis of hematopoetic related disorders such as anemia, pancytopenia, leukopenia, thrombocytopenia or leukemia, since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:186 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 927 of SEQ ID NO:186, b is an integer of 15 to 941, where both a and b correspond to the positions of nucleotide residues shown in SEQ ID NO:186, and where b is greater than or equal to a+14.

Features of Protein Encoded by Gene No: 177

This gene is expressed primarily in endothelial cells.

Therefore, polynucleotides and polypeptides of the invention are useful as reagents for differential identification of the tissue(s) or cell type(s) present in a biological sample and for diagnosis of diseases and conditions which include, but are not limited to, vascular disorders, including vascular restenosis. Similarly, polypeptides and antibodies directed to these polypeptides are useful in providing immunological probes for differential identification of the tissue(s) or cell type(s). For a number of disorders of the above tissues or cells, particularly of the vascular system, expression of this gene at significantly higher or lower levels may be routinely detected in certain tissues or cell types (e.g., vascular, endothelial, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in endothelial tissue indicates that the protein product of this gene is useful for treating diseases associated with vascular responses to injury such as vascular restenosis following angioplasty. Moreover, the protein product of this gene is useful for the treatment, detection, and/or prevention of a variety of other vascular disorders, which include, but are not limited to microvascular disease, embolism, thrombosis, atherosclerosis, aneurysm, or stroke. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:187 and may have been publicly available prior to conception of the present invention. Preferably, such related polynucle6tides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 664 of SEQ ID NO:187, b is an integer of 15 to 678, where both a and b correspond to the positions of nucleotide residues shown in SEQ ID NO:187, and where b is greater than or equal to a+14.

Features of Protein Encoded by Gene No: 178

This gene appears to be chimeric. There are two ORFs of interest. The first ORF-1 encodes a polypeptide preferrably comprising one of the following polypeptide sequences: MRPDWKAGAGPGGPPQKPAPSSQRKP-PARPSAAAAAIAVAAAEEERRLRQRNRL-RLEEDKPAVERCLEELVFGDV-ENDEDALLRRLRGPRVQEHEDSGDSEVENEAKGNF PPQKKPVWVDEEDEDEEMVDMNREKDM-MKNASESK LSKDNLKKRLKEEFQHAMGGVPAWA-ETTKRKTSSD DESEEDEDDLLQRTGNFISTSTSL-PRGILKMKNCQ HANAERPTVARISICAVPSRCTDCDGCWD (SEQ ID NO:1141); and/or CLEELVFGDVENDEDALLRRLRG-PRVQEHEDSGDSEVENEAKGNFP-PQKKPVWVDEEDEDEEMVDMMNNR-FRKDMMKNASESKLSKDNLKKRLKEEFQHAMGGV PAWAETTKRKTSSDDESEEDEDDLLQRTGNFIST STSLPRGILKMKNCQHANAERPTVARISICAVPS RCT-DCDGC (SEQ ID NO:1142). ORF-2 encodes a polypeptide preferably comprising one of the following polypeptide sequences: LKEKIVRSFEVSPDGSFLLING-IAGYLHLLAMKTKELIGSMKINGR-VAASTFSSDSKKVYASSGDGEVYVWDVN-SRKCLNRFVDEGSLYGLSIATSRNGQYVACGSNCGV VNIYNQDSCLQETNPKPIKAIMNLVTGVTSLTFNPT TEILAIASEKMKEAVRLVHLPSCTVFSNFPVIKNKN ISHVHTMDFSPRSGYFALGNEKGKALMYRLHHYSDF (SEQ ID NO:1143); and/or KINGRVAASTFSSDSKKV-YASSGDGEVYVWDVNSRKCLNRFVDEGSLYGLS IATSRNGQYVACGSNCGVVNIYNQDSCLQETNP KPI-KAIMNLVTGVTSLTFNPTTEILAIASEKMK EAVR-LVHLPSCTVFSNFPVIKNKNISHVHTMDF SPRSGY-FALGNEKGKAL (SEQ ID NO:1144). In specific embodiments, polypeptides of the invention comprise the following amino acid sequence: WLLGLDNAVS-LFQVDGKTNPKIQSIYLERFPIFKACF-SANGEEVLATSTHSKVLYVYD (SEQ ID NO:1145), LVFGDVENDEDALLRRLRGPRVQ (SEQ ID NO:1146), KNASESKLSKDNLKKRLKEEFQHAMGGVP (SEQ ID NO:1147), and/or SLPRGILKMKNCQHANAERPTVA (SEQ ID NO:1148). Polynucleotides encoding these polypeptides are also encompassed by the invention.

Moreover, the translation product of this gene shares homology with the transcriptional repressor TUP1 of *Candida albicans* (See Genbank Accession No. gi|2245634 (AF005741)), which is thought to modulate the expression levels of cellular filament and may implicate this protein as serving a useful role in the amelioration of proliferating cells and tissues.

This gene is expressed primarily in epidydimus and endometrial tumors, and to a lesser extent, in T cell lymphoma and cell lines derived from colon cancer.

Therefore, polynucleotides and polypeptides of the invention are useful as reagents for differential identification of the tissue(s) or cell type(s) present in a biological sample and for diagnosis of diseases and conditions which include, but are not limited to, reproductive or developmental conditions, which include tumors of the reproductive organs, including testis and endometrial cells. Similarly, polypeptides and antibodies directed to these polypeptides are useful in providing immunological probes for differential identification of the tissue(s) or cell type(s). For a number of disorders of the above tissues or cells, particularly of the reproductive system, expression of this gene at significantly higher or lower levels may be routinely detected in certain tissues or cell types (e.g., reproductive, developmental, and cancerous and wounded tissues) or bodily fluids (e.g., lymph, amniotic fluid, seminal fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 426 as residues: Ser-67 to Lys-72, Val-87 to Leu-93, Tyr-128 to Pro-141, Asp-204 to Gly-210.

The tissue distribution in reproductive tissue cancers, combined with the homology to a transcriptional repressor protein, indicates that the protein products of this gene are useful for treating tumors of the endometrium or epithelial tumors of the reproductive system. Moreover, the protein may also be useful as a contraceptive. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:188 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1834 of SEQ ID NO:188, b is an integer of 15 to 1848, where both a and b correspond to the positions of nucleotide residues shown in SEQ ID NO:188, and where b is greater than or equal to a+14.

Features of Protein Encoded by Gene No: 179

Preferred polypeptides encoded by this gene comprise the following amino acid sequence: MRILQLILLALATGLVG-GETRIIKGFECKLHSQPWQAALFEKTR-LLCGATLIAPRWLLTAAHCLKPRYIVHLGQHNL QKEEGCEQTRTATESFPHPGFNNSLP-NKDHRNDIMLVKMASPVSITWAVR-PLTLSSRCVTAGTSCSFPAGAARPDPSY-ACLTPCDAPTSPSLSTRSVRTPTPATSQTPWCVPACR KGARTPARVTPGALWSVTSLFKALSPGARIRVRSPES LVSTRKSANMWTGSRRR (SEQ ID NO:1149); ETRI-IKGFECKLHSQPWQAALFEKTRLLCGATLIAPR WLL-TAAHCLKPRYIVHLGQHNLQKEEGCEQTRT ATESF-PHPGFNNSLPNKDHRNDIMLVKMASPVSITWAVRPLT LSSRCVTAGTSCSFPAGAARPDPSYACLTPCDAPTSP SLSTRSVRTPTPATSQTPWCVPACRKGARTPARVTPG ALWSVTSLFKALSPGARIRVRSPESLVSTRKSANMWT GSRRR (SEQ ID NO:1 150); and/or CKLHSQPWQAAL-FEKTRLLCGATLIAPRWLLTAAHCLK-PRYIVHLGQHNLQKEEGCEQTRTATESFPHPGFNNS (SEQ ID NO:1151). The translation product of this gene shares sequence homology with neuropsin, a novel serine protease, which is thought to be important in modulating extracellular signalling pathways in the brain. Owing to the structural similarity to other serine proteases, the protein products of this gene are expected to have serine protease activity which may be assayed by methods known in the art and described elsewhere herein. Moreover, this protein has been shown to also have homology to PSA (prostate specific antigen). PSA is a serum marker for prostate cancer and it is a member of the kallikrein family. The members of the kallikrein family are secreted serine proteases and some of them are good tissue specific markers. This new member of the kallikrein family has been detected twice in endometrial tumor cDNA library and therefore is a good candidate as a serum marker for endometrial tumor.

This gene is expressed primarily in endometrial tumor, and to a lesser extent, in colon cancer, benign hypertrophic prostate, and thymus.

Therefore, polynucleotides and polypeptides of the invention are useful as reagents for differential identification of the tissue(s) or cell type(s) present in a biological sample and for diagnosis of diseases and conditions which include, but are not limited to, reproductive, immune, or endocrine disorders, particularly cancers of the endometrium or colon and benign hypertrophy of the prostate. Similarly, polypeptides and antibodies directed to these polypeptides are useful in providing immunological probes for differential identification of the tissue(s) or cell type(s). For a number of disorders of the above tissues or cells, particularly of the urogenital or reproductive systems, expression of this gene at significantly higher or lower levels may be routinely detected in certain tissues or cell types (e.g., reproductive, immune, endocrine, gastrointestinal, and cancerous and wounded tissues) or bodily fluids (e.g., lymph, serum, seminal fluid, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 427 as residues: Glu-27 to Trp-35, Leu-77 to Ala-89, Pro-96 to Asn-109, Ser-149 to Arg-156, Gln-172 to Ile-182, Glu-193 to Gly-204, Glu-245 to Asn-250.

The tissue distribution in proliferative reproductive tissues, combined with the homology to serine proteases indicates that the protein product of this gene is useful for diagnosing, treating, and/or preventing hyperproliferative disorders such as cancer of the endometrium or colon and hyperplasia of the prostate. Similarly, expression within cellular sources marked by proliferating cells indicates that this protein may play a role in the regulation of cellular division, and may show utility in the diagnosis and treatment of cancer and other proliferative disorders. Similarly, developmental tissues rely on decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:189 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a−b, where a is any integer between 1 to 1278 of SEQ ID NO:189, b is an integer of 15 to 1292, where both a and b correspond to the positions of nucleotide residues shown in SEQ ID NO:189, and where b is greater than or equal to a+14.

Features of Protein Encoded by Gene No: 180

Preferred polypeptides encoded by this gene comprise the following amino acid sequence: VLQGRYFSPILEMRRL-RPEGXNLPGGSRAQKEPRQDLTLVLWPH-CPBFAMTRSYVPTKQCMVQGSFYCWIFKGPVQNWC (SEQ ID NO:1152), and/or CPRRRTCVRVEKSRPFQC-QLHSIS (SEQ ID NO:1153). Polynucleotides encoding such polypeptides are also provided.

This gene is expressed primarily in fetal brain.

Therefore, polynucleotides and polypeptides of the invention are useful as reagents for differential identification of the tissue(s) or cell type(s) present in a biological sample and for diagnosis of diseases and conditions which include, but are not limited to, neural disorders, particularly neurodegenerative conditions, in addition to identifying and expanding stem cells in the CNS. Similarly, polypeptides and antibodies directed to these polypeptides are useful in providing immunological probes for differential identification of the tissue(s) or cell type(s). For a number of disorders of the above tissues or cells, particularly of the nervous system, expression of this gene at significantly higher or lower levels may be routinely detected in certain tissues or cell types (e.g., neural, developmental, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 428 as residues: Met-1 to Lys-9, Glu-26 to Lys-37, Lys-39 to Lys-48.

The tissue distribution in fetal brain indicates that the protein products of this gene are useful for detecting and expanding stem cell populations in the (or of the) central nervous system. Moreover, the protein product of this gene is useful for the detection/treatment of neurodegenerative disease states, behavioural disorders, or inflammatory conditions which include, but are not limited to Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:190 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 892 of SEQ ID NO:190, b is an integer of 15 to 906, where both a and b correspond to the positions of nucleotide residues shown in SEQ ID NO:190, and where b is greater than or equal to a+14.

Features of Protein Encoded by Gene No: 181

In specific embodiments, polypeptides of the invention comprise the following amino acid sequence: PKEPGVPE (SEQ ID NO:1154), LQLKPRDPFSTLGPNAVLSPQRLV-LETLSKLSIQDNNVDLILATPPFSRLE-KLYSTMVRFLSDRKNPVCRRWLWY-CWPTWLRGTAWQLVPLQCRRAVSATSWAS (SEQ ID NO:1155), RDPFSTLGPNAVLSPQRLVLETLSKLS (SEQ ID NO:1156), EVISGLFIQSRRRERGQGVVGSHMIL-WGKSLFFFSPQRLTKNIFKNYSLLLTQR-FLFPCETLLLQYVYSIRCTVQYMKGST-LYCTGLSSEQGLFTTANFLAPARL (SEQ ID NO:1157), and/or IRCTVQYMKGSTLYCTGLSSEQG (SEQ ID NO:1158). Polynucleotides encoding these polypeptides are also encompassed by the invention.

This gene is expressed primarily in early stage human brain, fetal liver/spleen, and stromal cells.

Therefore, polynucleotides and polypeptides of the invention are useful as reagents for differential identification of the tissue(s) or cell type(s) present in a biological sample and for diagnosis of diseases and conditions which include, but are not limited to, developmental abnormalities, neural, immune, or hematopoietic disorders. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues or cell types (e.g., developmental, neural, immune, hematopoietic, and cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 429 as residues: Gln-42 to Gln-47, Gln-54 to Pro-60.

The tissue distribution in embryonic brain and fetal liver indicates that the protein products of this gene play a role in the development of the central nervous and hematopoietic systems. Therefore this gene and its products are useful for diagnosing or treating developmental abnormalities of the central nervous system. Moreover, the protein product of this gene is useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:191 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1927 of SEQ ID NO:191, b is an integer of 15 to 1941, where both a and b correspond to the positions of nucleotide residues shown in SEQ ID NO:191, and where b is greater than or equal to a+14.

Features of Protein Encoded by Gene No: 182

Preferred polypeptides encoded by this gene comprise the following amino acid sequence: MPIIDQVNPELHDFMQ-SAEVGTIFALSWLYIWFGHVLSDFRHV-VRLYDFFLACHPLMPIYFAAVIV-LYREQEVLDCDCDMASVHHLLSQEPQDLPYETLISR XETLFSFPHPNLLGRPLPNSKLRGRQPLLSKTLSWH QPSRGLIWCCGSGXRGLLRPEDRTKDVLTKPRTNRF VKLAVMGLTVALGAAALAWKSALEWAPKFQLQLFP (SEQ ID NO:1159; "ORF-1"); or CPEFFIPATLPCPFV-FAFTSEASSRAYLTQRGPGGLAQNLM-PLPVGFWMGSLPPPWCWRKWVSEACSCFC (SEQ ID NO:1160; "ORF-2"). ORF-2 is structurally similar to various TGF-beta family members. Thus, this polypeptide is expected to have a variety of activities in the modulation of cell growth and proliferation. In specific embodiments, polypeptides of the invention comprise the following amino acid sequence: CRQAGAVRGHPMFQFTFYGVTXRF-PVTRAAQAQQVAKAAASFRNPLPPTPGR-WQRAHPKAHWERHKILCQAPRSPLCQVGSATGL (SEQ ID NO:1161), HILNYLMPIIDQVNPELHDFMQ-SAEVGTIFALSWLIEWFGHVLSDFRH-VWRLYDFFLACHPLMPIYFAAVIV-LYREQEVLDCDCDMASVHHLLSQIPQDLPYETLISRX ETFLFSFPHPNLLGRPLPNSKLRGRQPLLSKTLSWHQ PSRGLIWCCGSGXRGLLRPEDRTKDVLT-KPRTNRFVK LAVMGLTVALGAAALAWKSALEWAP-KFQLQLFP (SEQ ID NO:1162), AEVGTIFALSWLITWF-GHVLSDFRHVVRLYD (SEQ ID NO:1163), and/or VLTKPRTNRFVKLAVMGLTVALGAAALAVVKSA (SEQ ID NO:1164). Polynucleotides encoding these polypeptides are also encompassed by the invention. The gene encoding the disclosed cDNA is believed to reside on chromosome 20. Accordingly, polynucleotides related to this invention are useful as a marker in linkage analysis for chromosome 20.

This gene is expressed primarily in osteoclastoma, microvascular endothelium, and bone marrow derived cell lines.

Therefore, polynucleotides and polypeptides of the invention are useful as reagents for differential identification of the tissue(s) or cell type(s) present in a biological sample and for diagnosis of diseases and conditions which include, but are not limited to, skeletal, vascular, or hematological diseases, particularly those involving aberrant proliferation of stem cells. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., skeletal, vascular, immune, hematological, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 430 as residues: Ser-33 to Ala-39.

The tissue distribution in bone marrow and endothelial cells indicates that the protein products of this gene is useful for treating disorders of the progenitors of the immune system. Applications include in vivo expansion of progenitor cells, ex vivo expansion of progenitor cells, or the treatment of tumors of the circulatory system, such as lymphomas. Moreover, the protein product of this gene may also show utility in either the enhancement or inhibition of immune cell localization or targeting at sites of inflammation or injury. The protein product of this gene may be useful in the treatment, detection, and/or prevention of a variety of vascular disorders, which include, but are not limited to, microvascular disease, embolism, aneurysm, atherosclerosis, or stroke. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:192 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2104 of SEQ ID NO:192, b is an integer of 15 to 2118, where both a and b correspond to the positions of nucleotide residues shown in SEQ ID NO:192, and where b is greater than or equal to a+14.

Features of Protein Encoded by Gene No: 183

In specific embodiments, polypeptides of the invention comprise the sequence:GFGSVSAAGRRSGGTWQPVQ (SEQ ID NO:1165), PGGLAVGSRWWSRSLT (SEQ ID NO:1166), LEPSRQRRPRRRGGTSRPET-DQRAKCWRQL (SEQ ID NO:1167), and/or VCLRCQN-RMEN (SEQ ID NO:1168). In further specific embodiments, polypeptides of the invention comprise the sequence: MAACTARRPGRGQPLVVPVADXGPVA-KAALCAAXAGAFSPASTITRRESSRNR-PEGKVLETVGVFEVPKQNGKYET-GQLFLHSIFGYRGVVLFPWQARLXDRDVASAAPEK AENPAGHGSKEVKGKTHTYYQVLIDARDCPHISQR SQTEAVTFLANHDDSRALYAIPGLDYVSHEDILPY TSTDQVPIQHELFERFLLYDQTKAPPFVARETLRA WQEKNHPWLELSDVHRETTENIRVTVIPFYMGMRE AQNSHVYWWRYCIRLENLDSDVVQLRERHWRIFSL SGTLETVRGRGVVGREPVLSKEQPAFQYSSHVSLQ ASSGHMWGTFRFERPDGSHFDVRIPPFSLESNKDE KTPPSGLHW (SEQ ID NO:1169), MAACTARRPGRGQ-PLVVPVADXGPVAKAALCAA (SEQ ID NO:1170), MAACTARRPGRGQPLVVPVADXGPVAKAALCAA (SEQ ID NO:1171), MAACTARRPGRGQPLVVP-VADXGPVAKAALCAA (SEQ ID NO:1172), MAACTAR-RPGRGQPLVVPVADXGPVAKAALCAA (SEQ ID NO:1173), IAACTARRPGRGQPLVVPVADXGPVA-KAALCAA (SEQ ID NO:1174), VLETVGVFEVP-KQNGKYETGQLFLHSIFGYRGVVL (SEQ ID NO:1175), GLDYVSHEDILPYTST (SEQ ID NO:1176), DVHRETTENIRVTVIPFYM (SEQ ID NO:1177), WWRY-CIRLENLDSDVVQLRER (SEQ ID NO:1178), PAFQYSSHVSLQASSGHMWGTFRFER (SEQ ID NO:1179), RLPSHKRRCFCLVIQKKSFKEFMLDGN-LISGGVGEDVFMADIVQAWDG-IEGPTVIMVSQEGHSFCLRSLRYM-WAVTSINQHLIVSVSFAFHLLGAMASRVLCFFWSCRS HIPVXQSGLPGKQDDTSVAKNAMKEKLPGLIFSILFW HLKHTNCLQHFALWSVSGREVPPRRRGR-RWREGSSXG RAQSGLGHRAXVSDRDHQRLPTARP-PGCTGCHVPPER RPAADTEPNP (SEQ ID NO:1180), KEFMLDGNLISGGVGEDVFMADIVQAWDGIE (SEQ ID NO:1181), AVTSINQHLIVSVSFAFHLLGAM-ASRVLC (SEQ ID NO:1182), and/or TARPPGCTGCHVP-PERRPAA (SEQ ID NO:1183). Polynucleotides encoding these polypeptides are also encompassed by the invention. The gene encoding the disclosed cDNA is believed to reside on chromosome 17. Accordingly, polynucleotides related to this invention are useful as a marker in linkage analysis for chromosome 17.

This gene is expressed primarily in gall bladder, prostate, and fetal brain, and to a lesser extent, in tumor and fetal tissues.

Therefore, polynucleotides and polypeptides of the invention are useful as reagents for differential identification of the tissue(s) or cell type(s) present in a biological sample and for diagnosis of diseases and conditions which include, but are not limited to, gastrointestinal, reproductive, neural, or growth related disorders such as cancers. Similarly, polypeptides and antibodies directed to these polypeptides are useful in providing immunological probes for differential identification of the tissue(s) or cell type(s). For a number of disorders of the above tissues or cells, particularly of the prostate, gall bladder, and fetal brain, expression of this gene at significantly higher or lower levels may be routinely detected in certain tissues or cell types (e.g., gastrointestinal, reproductive, neural, developmental, and cancerous and wounded tissues) or bodily fluids (e.g., lymph, amniotic fluid, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in fetal brain and tumor tissues indicates that the protein product of this gene is useful for the diagnosis and treatment of growth-related disorders, such as cancers. Moreover, the protein product of this gene is useful for the detection/treatment of neurodegenerative disease states, behavioural disorders, or inflammatory conditions which include, but are not limited to Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransmission, learning, cognition, homeostasis, or neuronal differentiation or survival, in addition to metabolic, or reproductive disorders. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:193 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1524 of SEQ ID NO:193, b is an integer of 15 to 1538, where both a and b correspond to the positions of nucleotide residues shown in SEQ ID NO:193, and where b is greater than or equal to a+14.

Features of Protein Encoded by Gene No: 184

In specific embodiments, polypeptides of the invention comprise the sequence:SLCCPEGAEGC (SEQ ID NO:1184), QLKKTHYDRPCP (SEQ ID NO:1185), QLKK-THYDRPCP (SEQ ID NO:1186), MNRPCPFCLWKVF-PLLLLLHEELFPLPVP (SEQ ID NO:1187), and/or KEK-TFTPRNSLCCPEGAEGCIAGGDLQLKKTHY (SEQ ID NO:1188). Polynucleotides encoding these polypeptides are also encompassed by the invention.

This gene is expressed primarily in stromal cell, tonsil, and glioblastoma.

Therefore, polynucleotides and polypeptides of the invention are useful as reagents for differential identification of the tissue(s) or cell type(s) present in a biological sample and for diagnosis of diseases and conditions which include, but are not limited to, hematopoietic, immune and inflammatory disorders, in addition to neural disorders, such as glioblastoma. Similarly, polypeptides and antibodies directed to these polypeptides are useful in providing immunological probes for differential identification of the tissue(s) or cell type(s). For a number of disorders of the above tissues or cells, particularly of the stromal cells, tonsil, and glioblastoma expression of this gene at significantly higher or lower levels may be routinely detected in certain tissues or cell types (e.g., immune, hematopoietic, neural, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder. Additionally, it is believed that the product of this gene regulates pancreatic cell differentiation into beta cells. Accordingly, polynucleotides and polypeptides of the invention are useful in the treatment of insulin-dependent diabetes mellitus and associated conditions e.g. pancreatic hypofunction and the prevention, as well as the treatment of undifferentiated type pancreatic cancers.

Preferred epitopes include those comprising a sequence shown in SEQ ID NO: 432 as residues: Pro-27 to Ala-32.

The tissue distribution in stromal cells and tonsils indicates that the protein product of this gene is useful for diagnosis and treatment of immune and inflammatory disorders and glioblastoma. Similarly, the protein product of this gene is useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:194 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1084 of SEQ ID NO:194, b is an integer of 15 to 1098, where both a and b correspond to the positions of nucleotide residues shown in SEQ ID NO:194, and where b is greater than or equal to a+14.

Features of Protein Encoded by Gene No: 185

This gene is expressed primarily in hepatocellular carcinoma.

Therefore, polynucleotides and polypeptides of the invention are useful as reagents for differential identification of the tissue(s) or cell type(s) present in a biological sample and for diagnosis of diseases and conditions which include, but are not limited to, hepatic or metabolic diseases. Similarly, polypeptides and antibodies directed to these polypeptides are useful in providing immunological probes for differential identification of the tissue(s) or cell type(s). For a number of disorders of the above tissues or cells, particularly of the liver, expression of this gene at significantly higher or lower levels may be routinely detected in certain tissues or cell types (e.g., hepatic, metabolic, immune, hematopoietic, and cancerous and wounded tissues) or bodily fluids (e.g., lymph, serum, bile, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 433 as residues: Gly-32 to Lys-39.

The tissue distribution in hepatocellular carcinoma tissue indicates that the protein product of this gene is useful for diagnosis and treatment of liver diseases. Moreover, the protein product of this gene is useful for the detection and treatment of liver disorders and cancers (e.g. hepatoblastoma, jaundice, hepatitis, liver metabolic diseases and conditions that are attributable to the differentiation of hepatocyte progenitor cells). In addition the protein may have a useful role in treating, detecting, or preventing developmental abnormalities, fetal deficiencies, pre-natal disorders and various would-healing models and/or tissue trauma. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:195 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 987 of SEQ ID NO:195, b is an integer of 15 to 1001, where both a and b correspond to the positions of nucleotide residues shown in SEQ ID NO:195, and where b is greater than or equal to a+14.

Features of Protein Encoded by Gene No: 186

This gene is expressed primarily in hippocampus.

Therefore, polynucleotides and polypeptides of the invention are useful as reagents for differential identification of the tissue(s) or cell type(s) present in a biological sample and for diagnosis of diseases and conditions which include, but are not limited to, neuronal or endocrine disorders, particularly behavioral and mood disorders. Similarly, polypeptides and antibodies directed to these polypeptides are useful in providing immunological probes for differential identification of the tissue(s) or cell type(s). For a number of disorders of the above tissues or cells, particularly of the hippocampus, expression of this gene at significantly higher or lower levels may be routinely detected in certain tissues or cell types (e.g., neural, endocrine, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 434 as residues: Ser-14 to Tyr-20.

The tissue distribution in hippocampus indicates that the protein product of this gene is useful for the diagnosis and treatment of neuronal disorders. Moreover, the protein product of this gene is useful for the detection/treatment of neurodegenerative disease states, behavioural disorders, or inflammatory conditions which include, but are not limited to Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In addition, elevated expression of this gene product in regions of the brain indicates that it plays a role in normal neural function. Potentially, this gene product is involved in synapse formation, neurotransrmission, learning, cognition, homeostasis, or neuronal differentiation or survival. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:196 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1444 of SEQ ID NO:196, b is an integer of 15 to 1458, where both a and b correspond to the positions of nucleotide residues shown in SEQ ID NO:196, and where b is greater than or equal to a+14.

Features of Protein Encoded by Gene No: 187

This gene is expressed primarily in bone cancer and hippocampus, and to a lesser extent, in osteoclastoma.

Therefore, polynucleotides and polypeptides of the invention are useful as reagents for differential identification of the tissue(s) or cell type(s) present in a biological sample and for diagnosis of diseases and conditions which include, but are not limited to, bone-related disorders and neuronal diseases. Similarly, polypeptides and antibodies directed to these polypeptides are useful in providing immunological probes for differential identification of the tissue(s) or cell type(s). For a number of disorders of the above tissues or cells, particularly of the bone, ostoeclast, and hippocampus, expression of this gene at significantly higher or lower levels may be routinely detected in certain tissues or cell types (e.g., neural, skeletal, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in hippocampus and skeletal tissues indicates that the protein product of this gene is useful for diagnosis and treatment of bone-related disorders and neuronal diseases. Similarly, this gene product is useful in the detection and treatment of disorders and conditions affecting the skeletal system, in particular osteoporosis, bone cancer, as well as, disorders afflicting connective tissues (e.g. arthritis, trauma, tendonitis, chrondomalacia and inflammation), such as in the diagnosis or treatment of various autoimmune disorders such as rheumatoid arthritis, lupus, scleroderma, and dermatomyositis as well as dwarfism, spinal deformation, and specific joint abnormalities as well as chondrodysplasias (ie. spondyloepiphyseal dysplasia congenital familial osteoarthritis, Atelosteogenesis type II, metaphyseal chondrodysplasia type Schmid). Alternatively, the protein product of this gene is useful for the detection/treatment of neurodegenerative disease states, behavioural disorders, or inflammatory conditions. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:197 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1268 of SEQ ID NO:197, b is an integer of 15 to 1282, where both a and b correspond to the positions of nucleotide residues shown in SEQ ID NO:197, and where b is greater than or equal to a+14.

Features of Protein Encoded by Gene No: 188

The gene encoding the disclosed cDNA is thought to reside on chromosome 4. Accordingly, polynucleotides related to this invention are useful as a marker in linkage analysis for chromosome 4.

This gene is expressed primarily in neuronal tissues such as hippocampus, spinal cord, and hypothalamus.

Therefore, polynucleotides and polypeptides of the invention are useful as reagents for differential identification of the tissue(s) or cell type(s) present in a biological sample and for diagnosis of diseases and conditions which include, but are not limited to, neuronal diseases. Similarly, polypeptides and antibodies directed to these polypeptides are useful in providing immunological probes for differential identification of the tissue(s) or cell type(s). For a number of disorders of the above tissues or cells, particularly of the neuronal tissues, expression of this gene at significantly higher or lower levels may be routinely detected in certain tissues or cell types (e.g. neuronal, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neuronal tissues indicates that the protein product of this gene is useful for diagnosis and treatment of neuronal disorders, such as Alzheimers Disease, Parkinsons Disease, Huntingtons Disease, Tourette Syndrome, schizophrenia, mania, dementia, paranoia, obsessive compulsive disorder, panic disorder, learning disabilities, ALS, psychoses, autism, and altered bahaviors, including disorders in feeding, sleep patterns, balance, and perception. In addition, the gene or gene product may also play a role in the treatment and/or detection of developmental disorders associated with the developing embryo, or sexually-linked disorders. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:198 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 937 of SEQ ID NO:198, b is an integer of 15 to 951, where both a and b correspond to the positions of nucleotide residues shown in SEQ ID NO:198, and where b is greater than or equal to a+14.

Features of Protein Encoded by Gene No: 189

The gene encoding the disclosed cDNA is thought to reside on chromosome 10. Accordingly, polynucleotides related to this invention are useful as a marker in linkage analysis for chromosome 10.

This gene is expressed primarily in neuronal tissues and immune tissues.

Therefore, polynucleotides and polypeptides of the invention are useful as reagents for differential identification of the tissue(s) or cell type(s) present in a biological sample and for diagnosis of diseases and conditions which include, but are not limited to, neuronal and immune-related disorders. Similarly, polypeptides and antibodies directed to these polypeptides are useful in providing immunological probes for differential identification of the tissue(s) or cell type(s). For a number of disorders of the above tissues or cells, particularly of the neuronal and immune-related tissues, expression of this gene at significantly higher or lower levels may be routinely detected in certain tissues or cell types (e.g. neuronal, immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 437 as residues: Pro-19 to Asp-25.

The tissue distribution neuronal and immune tissues indicates that the protein product of this gene is useful for the diagnosis and treatment of neuronal and immune-related disorders. Furthermore, the tissue distribution indicates that the protein product of this gene is useful for the detection/treatment of neurodegenerative disease states, neuronal disorders, and behavioural disorders such as Alzheimers Disease, Parkinsons Disease, Huntingtons Disease, Tourette Syndrome, schizophrenia, mania, dementia, paranoia, obsessive compulsive disorder, panic disorder, learning disabilities, ALS, psychoses, autism, and altered bahaviors, including disorders in feeding, sleep patterns, balance, and perception. In addition, the gene or gene product may also play a role in the treatment and/or detection of developmental disorders associated with the developing embryo, or sexually-linked disorders. Additionally, this gene product may be involved in the regulation of cytokine production, antigen presentation, or other processes that may also suggest a usefulness in the treatment of cancer (e.g. by boosting immune responses). Since the gene is expressed in cells of lymphoid origin, the gene or protein, as well as, antibodies directed against the protein may show utility as a tumor marker and/or immunotherapy targets for the above listed tissues. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:199 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1726 of SEQ ID NO:199, b is an integer of 15 to 1740, where both a and b correspond to the positions of nucleotide residues shown in SEQ ID NO:199, and where b is greater than or equal to a+14.

Features of Protein Encoded by Gene No: 190

The translation product of this gene shares sequence homology with human N33, a gene located in a homozygously deleted region of human metastatic prostate cancer, which is thought to be important in prevention of prostate cancer. The gene and its translation product also share sequence homology with an isolated prostate/colon tumour suppressor gene (PSTG) product (WO9532214-A1.). In specific embodiments, polypeptides of the invention comprise the sequence: AQRKKEMVLSEKVSQLMEWT-NKRPVIRMNGDKFRRLVKAPPRNYS-VIVMFTALQLHRQCVVCKQADEEFQILANSWRYSS AFTNRIFFAMVDFDEGSDVFQMLNMNSAPTFINFP AKGKPKRGDTYELQVRGFSAEQIARWIADRTDVNI RVIRPPNMAARWRFWCVSVT (SEQ ID NO:1189), MVVALLIVCDVPSAS (SEQ ID NO:1190), AQRKKEMVLSEKVSQL (SEQ ID NO:1191), MEWT-NKRPVIRMNGDKF (SEQ ID:1192), RRLVKAP-PRNYSWVMFIALQLHRQCVVCKQADEEF-QILANSWRYSSAFTNRIFFA (SEQ ID NO:1193), MVDFDEGSDVFQMLNMNSAPTFINFPAKGKP (SEQ ID NO:1194), KRGDTYELQVRGFSAEQIARWIADRTD-VNIRVIRPPN (SEQ ID NO:1195), and/or YAGPLM-LGLLLAVIGGLVYLRRVIWNFSLIKLDG-LLQLCVLCLL (SEQ ID NO:1196). Polynucleotides encoding these polypeptides are also encompassed by the invention.

This gene is expressed primarily in infant adrenal gland, prostate cell line, and to a lesser extent in adrenal gland.

Therefore, polynucleotides and polypeptides of the invention are useful as reagents for differential identification of the tissue(s) or cell type(s) present in a biological sample and for diagnosis of diseases and conditions which include, but are not limited to, prostate cancer and endocrine disorders. Similarly, polypeptides and antibodies directed to these polypeptides are useful in providing immunological probes for differential identification of the tissue(s) or cell type(s). For a number of disorders of the above tissues or cells, particularly of the prostate and adrenal gland, expression of this gene at significantly higher or lower levels may be routinely detected in certain tissues or cell types (e.g. prostate, endocrine, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 438 as residues: Pro-34 to Gly-43, Arg-113 to Pro-120.

The tissue distribution infant adrenal gland, combined with the homology to N33 and prostate/colon tumour suppressor gene (PSTG) indicates that the protein product of this gene is useful for the diagnosis and treatment for prostate cancer and endocrine disorders, and that the nucleic acids and proteins of this gene can be used in the diagnosis and treatment of prostate, endocrine and colorectal cancers. Protein, as well as, antibodies directed against the protein may show utility as a tumor marker and immunotherapy targets for the above listed tumors and tissues.

Many polynucleotide sequences, such as EST sequences, are publicly available and accessible through sequence databases. Some of these sequences are related to SEQ ID NO:200 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1693 of SEQ ID NO:200, b is an integer of 15 to 1707, where both a and b correspond to the positions of nucleotide residues shown in SEQ ID NO:200, and where b is greater than or equal to a+14.

Features of Protein Encoded by Gene No: 191

This gene is expressed primarily in T-cell, and to a lesser extent in fetal lung.

Therefore, polynucleotides and polypeptides of the invention are useful as reagents for differential identification of the tissue(s) or cell type(s) present in a biological sample and for diagnosis of diseases and conditions which include, but are not limited to, immune and respiratory disorders. Similarly, polypeptides and antibodies directed to these polypeptides are useful in providing immunological probes for differential identification of the tissue(s) or cell type(s). For a number of disorders of the above tissues or cells, particularly of the immune and respiratory systems, expression of this gene at significantly higher or lower levels may be routinely detected in certain tissues or cell types (e.g. immune, respiratory, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 439 as residues: Trp-3 to Phe-9.

The tissue distribution in T-cells and fetal lung indicates that the protein product of this gene is useful for the diagnosis and treatment of immune and respiratory disorders. Furthermore, this gene product may be involved in the regulation of cytokine production, antigen presentation, or other processes that may also suggest a usefulness in the treatment of cancer (e.g. by boosting immune responses). Since the gene is expressed in cells of lymphoid origin, the gene or protein, as well as, antibodies directed against the protein may show utility as a tumor marker and/or immunotherapy targets for the above listed tissues. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. Expression of this gene product in T cells also strongly indicates a role for this protein in immune function and immune surveillance. The tissue distribution also indicates that the protein product of this gene is useful for the detection and treatment of disorders associated with developing lungs, particularly in premature infants where the lungs are the last tissues to develop. The tissue distribution indicates that the protein product of this gene is useful for the diagnosis and intervention of lung tumors, since the gene may be involved in the regulation of cell division, particularly since it is expressed in fetal tissue. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:201 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 765 of SEQ ID NO:201, b is an integer of 15 to 779, where both a and b correspond to the positions of nucleotide residues shown in SEQ ID NO:201, and where b is greater than or equal to a+14.

Features of Protein Encoded by Gene No: 192

The gene encoding the disclosed cDNA is thought to reside on chromosome 6. Accordingly, polynucleotides related to this invention are useful as a marker in linkage analysis for chromosome 6. The translation product of this gene shares significant homology with the rat protein Neuritin, and in fact appears to be a human ortholog of the rat protein. It is believed that this gene is induced in rats by neural activity and neurotrophins, and that it promotes neuritogenesis. Neural activity and neurotrophins induce synaptic remodeling in part by altering gene expression. This gene is believed to be a glycosylphoshatidylinositol-anchored protein encoded by a hippocampal gene, and to possess neural activity. This molecule is believed to be expressed in postmitotic-differentiating neurons of the developing nervous system and neuronal structures associated with plasticity in the adult. Message of this gene is believed to be induced by neuronal activity and by the activity-regulated neurotrophins BDNF and NT-3. The product of this gene is believed to stimulate neurite outgrowth and arborization in primary embryonic hippocampal and cortical cultures, and to act as a downstream effector of activity-induced neurite outgrowth. In specific embodiments, polypeptides of the invention comprise the sequence: DAVFKGFSDCLLKLGDS (SEQ ID NO:1197), CQEGAKDMWDKLRKESKNLN (SEQ ID NO:1198), VLLVSLSAALATWLSF (SEQ ID NO:1199), MGLKLNGRYISLILAVQIAYLVQAVRAAGKC-DAVFKGFSDCLLKLGDS (SEQ ID NO:1200), PAAWDDKTNIKTVCTYWEDFHSCTVTALTDCQEGAKDMWDKLRKESKNLNIQGSLFELCGSGNGAAGSLLPAFPVLLVSLSAALATWLSF (SEQ ID NO:1201), and/or MGLKLNGRYISLILAVQIAY-LVQAVRAAGKCDAVFKGFSDCLLKLGD-SXXXXXPAAWDDKTNIKTVCTYWEDFH-SCTVTALTDCQEGAKDMWDKLRKESKNLNIQGSLFELCGSGNGAAGSLLPAFPVLLVSLSAALATWLSF (SEQ ID NO:1202). Polynucleotides encoding this polypeptide are also encompassed by the invention.

This gene is expressed primarily in human placenta, endometrial tumor and tissues of the central nervous system (CNS).

Therefore, polynucleotides and polypeptides of the invention are useful as reagents for differential identification of the tissue(s) or cell type(s) present in a biological sample and for diagnosis of diseases and conditions which include, but are not limited to, relating to reproductive disorders, cancers and neurological diseases. Similarly, polypeptides and antibodies directed to these polypeptides are useful in providing immunological probes for differential identification of the tissue(s) or cell type(s). For a number of disorders of the above tissues or cells, particularly of the reproductive and neurological disorders, expression of this gene at significantly higher or lower levels may be routinely detected in certain tissues or cell types (e.g. reproductive, neurological, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 440 as residues: Asp-47 to Asp-63, His-75 to Tyr-80, Pro-83 to Tyr-89.

The tissue distribution indicates that the protein product of this gene is useful for the diagnosis and treatment of reproductive disorders such as endometrial tumors. Expression of this gene in tissues of the CNS, and its strong homology to Neuritin, suggest that the protein product from this gene is also useful in the treatment and diagnosis of neurological disorders and in the regeneration of neural tissues, e.g., following injury.

Many polynucleotide sequences, such as EST sequences, are publicly available and accessible through sequence databases. Some of these sequences are related to SEQ ID NO:202 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1603 of SEQ ID NO:202, b is an integer of 15 to 1617, where both a and b correspond to the positions of nucleotide residues shown in SEQ ID NO:202, and where b is greater than or equal to a+14.

Features of Protein Encoded by Gene No: 193

The translation product of this gene shares sequence homology with tenascin, which is thought to be important in development. The translation product of this gene is believed to be a ligand of the fibroblast growth factor family. FGF ligand activity is known in the art and can be assayed by methods known in the art and disclosed elsewhere herein.

Northern analysis indicates that a 2.5 kb band is expressed in brain and lung.

Therefore, polynucleotides and polypeptides of the invention are useful as reagents for differential identification of the tissue(s) or cell type(s) present in a biological sample and for diagnosis of diseases and conditions which include, but are not limited to, cancers, growth disorders of the brain and lung. Similarly, polypeptides and antibodies directed to these polypeptides are useful in providing immunological probes for differential identification of the tissue(s) or cell type(s). For a number of disorders of the above tissues or cells, particularly of the cancer tissues, brain, lung, expression of this gene at significantly higher or lower levels may be routinely detected in certain tissues or cell types (e.g. brain, lung, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 441 as residues: Gly-29 to Glu-34, Arg-71 to Arg-76, Thr-176 to Cys-182, Gly-184 to Glu-199.

The tissue distribution in brain and lung, combined with the homology to tenascin indicates that the protein product of this gene is useful for diagnosis and treatment of cancers. Alternatively, given the tissue distribution indicated by Northern analysis, the translation product of this gene is thought to be a growth factor functioning in the brain and lung that may be useful in treating neurodegneration and lung disorder. For example, the protein product of this gene is useful for the detection and treatment of disorders associated with developing lungs, particularly in premature infants where the lungs are the last tissues to develop. Furthermore, the tissue distribution indicates that the protein product of this gene is useful for the diagnosis and intervention of lung tumors, since the gene may be involved in the regulation of cell division. Additionally, expression in the brain indicates that it may be involved in neuronal survival; synapse formation; conductance; neural differentiation, etc. Such involvement may impact many processes, such as learning and cognition. It may also ie useful in the treatment of such neurodegenerative disorders as schizophrenia; ALS; or Alzheimer's. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:203 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a-b, where a is any integer between 1 to 1960 of SEQ ID NO:203, b is an integer of 15 to 1974, where both a and b correspond to the positions of nucleotide residues shown in SEQ ID NO:203, and where b is greater than or equal to a+14.

Features of Protein Encoded by Gene No: 194

In specific embodiments, polypeptides of the invention comprise the sequence: MNSAAGFSHLDRRERV-LKLGESFEKQPRCASTLC (SEQ ID NO:1203). Polynucleotides encoding these polypeptides are also encompassed by the invention.

This gene is expressed primarily in fetal human lung and neutrophils.

Therefore, polynucleotides and polypeptides of the invention are useful as reagents for differential identification of the tissue(s) or cell type(s) present in a biological sample and for diagnosis of diseases and conditions which include, but are not limited to, lung development and respiratory disorders. Similarly, polypeptides and antibodies directed to these polypeptides are useful in providing immunological probes for differential identification of the tissue(s) or cell type(s). For a number of disorders of the above tissues or cells, particularly of the respiratory system, expression of this gene at significantly higher or lower levels may be routinely detected in certain tissues or cell types (e.g. respiratory, immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in fetal lung and neutrophils indicates that the protein product of this gene is useful for the diagnosis and treatment of lung and immunity related diseases, for example, lung cancer, viral, fungal or bacterial infections (e.g. lesions caused by tuberculosis), inflammation (e.g. pneumonia), metabolic lesions etc. Furthermore, the tissue distribution indicates that the protein product of this gene is useful for the detection and treatment of disorders associated with developing lungs, particularly in premature infants where the lungs are the last tissues to develop. The tissue distribution indicates that the protein product of this gene is useful for the diagnosis and intervention of lung tumors, since the gene may be involved in the regulation of cell division, particularly since it is expressed in fetal tissue. Protein, as well as, antibodies directed against the protein may show utility as a tumor marker and immunotherapy targets for the above listed tumors and tissues.

Many polynucleotide sequences, such as EST sequences, are publicly available and accessible through sequence databases. Some of these sequences are related to SEQ ID NO:204 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a-b, where a is any integer between 1 to 1043 of SEQ ID NO:204, b is an integer of 15 to 1057, where both a and b correspond to the positions of nucleotide residues shown in SEQ ID NO:204, and where b is greater than or equal to a+14.

Features of Protein Encoded by Gene No: 195

This gene is expressed primarily in breast lymph node, and to a lesser extent in synovial tissues.

Therefore, polynucleotides and polypeptides of the invention are useful as reagents for differential identification of the tissue(s) or cell type(s) present in a biological sample and for diagnosis of diseases and conditions which include, but are not limited to, immune and skeletal disorders. Similarly, polypeptides and antibodies directed to these polypeptides are useful in providing immunological probes for differential identification of the tissue(s) or cell type(s). For a number of disorders of the above tissues or cells, particularly of the immune system and skeletal system, expression of this gene at significantly higher or lower levels may be routinely detected in certain tissues or cell types (e.g. immune, skeletal, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in breast lymph node and synovium indicates that the protein product of this gene is useful for the diagnosis and treatment of immune and skeletal disorders. Furthermore, this gene product may be involved in the regulation of cytokine production, antigen presentation, or other processes that may also suggest a usefulness in the treatment of cancer (e.g. by boosting immune responses). Since the gene is expressed in cells of lymphoid origin, the gene or protein, as well as, antibodies directed against the protein may show utility as a tumor marker and/or immunotherapy targets for the above listed tissues. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues. The expression of this gene product in synovium indicates a role in the detection and treatment of disorders and conditions affecting the skeletal system, in particular osteoporosis as well as disorders afflicting connective tissues (e.g. arthritis, trauma, tendonitis, chrondomalacia and inflammation), such as in the diagnosis or treatment of various autoimmune disorders such as rheumatoid arthritis, lupus, scleroderma, and dermatomyositis as well as dwarfism, spinal deformation, and specific joint abnormalities as well as chondrodysplasias (ie. spondyloepiphyseal dysplasia congenita, familial osteoarthritis, Atelosteogenesis type II, metaphyseal chondrodysplasia type Schmid). Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:205 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 707 of SEQ ID NO:205, b is an integer of 15 to 721, where both a and b correspond to the positions of nucleotide residues shown in SEQ ID NO:205, and where b. is greater than or equal to a+14.

Features of Protein Encoded by Gene No: 196

The gene encoding the disclosed cDNA is thought to reside on chromosome 5. Accordingly, polynucleotides related to this invention are useful as a marker in linkage analysis for chromosome 5. The translation product of this gene shares sequence homology with human M-phase phosphoprotein 4, which is thought to be important in the phosphorylation and signal transduction processes. In specific embodiments, polypeptides of the invention comprise the sequence:TIYTEEELQAVQKIVSITERALKLVSD (SEQ ID NO:1204), RALKGVLRVGVLAKGLLL-RGDRNVNLVLLC (SEQ ID NO:1205), ALAALRHAKW-FQARANGLQSCVIIIRILRDLCQRVPTWS (SEQ ID NO:1206), GDALRRVFECISSGIIL (SEQ ID NO:1207), LAFRQIHKVLGMDPLP (SEQ ID NO:1208), and/or TIYPTEEELQAVQKIVSITERALKLVSD-SLSEHEKNKNKEGDDKKEGGKDRALKGV-LRVGVLAKGLLLRGDRNVNLV-LLCSEKPSKTLLSRIAENLPKQLAVISPEKYDIKCAVS EAAIILNSCVEPKMQVTITLTSPIIREENMREGDVTSG MVKDPPDVLDRQKCLDALAALRHAKW-FQARANGLQSCV IIIRILRDLCQRVPTWSDF-PSWAMELLVEKAISSASSP QSPGDALRRVFECISSGI-ILKGSPGLLDPCEKDPFDTL ATMTDQQREDITSSAQFALRLLAFRQIH-KVLGMDPLPQ MSQRFNIIKRRRDSDGVDGFEAE-GKKDKKDYDNF (SEQ ID NO:1209), MERHPKKK-MCSD (SEQ ID NO:1210), and/or GENSSSDFFPLFLFYFLVALASPPIFVSFIN (SEQ ID NO:1211). Polynucleotides encoding these polypeptides are also encompassed by the invention.

This gene is expressed primarily in human hippocampus, and to a lesser extent in prostate and human frontal cortex.

Therefore, polynucleotides and polypeptides of the invention are useful as reagents for differential identification of the tissue(s) or cell type(s) present in a biological sample and for diagnosis of diseases and conditions which include, but are not limited to, disorders related to the reproductive and nervous systems. Similarly, polypeptides and antibodies directed to these polypeptides are useful in providing immunological probes for differential identification of the tissue(s) or cell type(s). For a number of disorders of the above tissues or cells, particularly of the reproductive and nervous systems, expression of this gene at significantly higher or lower levels may be routinely detected in certain tissues or cell types (e.g. reproductive, CNS, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 444 as residues: Arg-13 to Asp-21, Lys-28 to Lys-38, Val-76 to Asp-81, Ser-99 to Ala-107, Pro-130 to Phe-136, Thr-143 to Ile-150, Pro-176 to Phe-182, Asn-186 to Gly-196, Ala-202 to Phe-214.

The tissue distribution in human hippocampus, prostate, and frontal cortex, combined with the homology to human M-phase phosphoprotein 4 indicates that the protein product of this gene is useful for the diagnosis and treatment of reproductive and nervous system disorders. Furthermore, elevated expression of this gene product within the frontal cortex of the brain indicates that it may be involved in neuronal survival; synapse formation; conductance; neural differentiation, etc. Such involvement may impact many processes, such as learning and cognition. It may also be useful in the treatment of such neurodegenerative disorders as schizophrenia; ALS; or Alzheimer's. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:206 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2451 of SEQ ID NO:206, b is an integer of 15 to 2465, where both a and b correspond to the positions of nucleotide residues shown in SEQ ID NO:206, and where b is greater than or equal to a+14.

Features of Protein Encoded by Gene No: 197

In specfic embodiments, polypeptides of the invention comprise the sequence: MGSQHSAAARPSSCRRKQED-DRDG (SEQ ID NO:1212), LLAEREQEEAIAQF-PYVEFTGRDSITCLTC (SEQ ID NO:1213), andlor QGT-GYIPTEQVNELVALIPHSDQRLRPQRTKQYV (SEQ ID NO:1214). Polynucleotides encoding these polypeptides are also encompassed by the invention.

This gene is expressed primarily in human primary breast cancer, and to a lesser extent, in human adult spleen, Hodgkin's lymphoma I, and salivary gland.

Therefore, polynucleotides and polypeptides of the invention are useful as reagents for differential identification of the tissue(s) or cell type(s) present in a biological sample and for diagnosis of diseases and conditions which include, but are not limited to, cancer, as well as immune disorders. Similarly, polypeptides and antibodies directed to these polypeptides are useful in providing immunological probes for differential identification of the tissue(s) or cell type(s). For a number of disorders of the above tissues or cells, particularly cancers and the immune system, expression of this gene at significantly higher or lower levels may be routinely detected in certain tissues or cell types (e.g. immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 445 as residues: Ser-126 to Gly-138.

The tissue distribution in tumors of breast origins indicates that the protein product of this gene is useful for the diagnosis and intervention of these tumors, in addition to other tumors where expression has been indicated. Furthermore, the expression in hematopoietic cells and tissues indicates that this protein may play a role in the proliferation, differentiation, and/or survival of hematopoietic cell lineages. In such an event, this gene may be useful in the treatment of lymphoproliferative disorders, and in the maintenance and differentiation of various hematopoietic lineages from early hematopoietic stem and committed progenitor cells. Protein, as well as, antibodies directed against the protein may show utility as a tissue-specific marker and/or immunotherapy target for the above listed tissues.

Many polynucleotide sequences, such as EST sequences, are publicly available and accessible through sequence databases. Some of these sequences are related to SEQ ID NO:207 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1466 of SEQ ID NO:207, b is an integer of 15 to 1480, where both a and b correspond to the positions of nucleotide residues shown in SEQ ID NO:207, and where b is greater than or equal to a+14.

Features of Protein Encoded by Gene No: 198

This gene is expressed primarily in monocytes.

Therefore, polynucleotides and polypeptides of the invention are useful as reagents for differential identification of the tissue(s) or cell type(s) present in a biological sample and for diagnosis of diseases and conditions which include, but are not limited to, blood cell disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in monocytes indicates that the protein product of this gene is useful for the diagnosis and treatment of blood cell disorders. Furthermore, expression of this gene product in monocytes also strongly indicates a role for this protein in immune function and immune surveillance. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:208 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 858 of SEQ ID NO:208, b is an integer of 15 to 872, where both a and b correspond to the positions of nucleotide residues shown in SEQ ID NO:208, and where b is greater than or equal to a+14.

Features of Protein Encoded by Gene No: 199

The gene encoding the disclosed cDNA is thought to reside on chromosome 6. Accordingly, polynucleotides related to this invention are useful as a marker in linkage analysis for chromosome 6.

This gene is expressed primarily in human ovary and synovia, and to a lesser extent in human 8 week whole embryo.

Therefore, polynucleotides and polypeptides of the invention are useful as reagents for differential identification of the tissue(s) or cell type(s) present in a biological sample and for diagnosis of diseases and conditions which include, but are not limited to, reproductive and developmental disorders. Similarly, polypeptides and antibodies directed to these polypeptides are useful in providing immunological probes for differential identification of the tissue(s) or cell type(s). For a number of disorders of the above tissues or cells, particularly of the reproductive and developmental systems, expression of this gene at significantly higher or lower levels may be routinely detected in certain tissues or cell types (e.g. reproductive, developmental, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in human ovary and human 8 week whole embryo indicates that the protein product of this gene is useful for the diagnosis and treatment of reproductive and developmental disorders. Similarly, expression within embryonic tissue and other cellular sources marked by proliferating cells indicates that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:209 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1765 of SEQ ID NO:209, b is an integer of 15 to 1779, where both a and b correspond to the positions of nucleotide residues shown in SEQ ID NO:209, and where b is greater than or equal to a+14.

Features of Protein Encoded by Gene No: 200

The gene encoding the disclosed cDNA is thought to reside on chromosome 8. Accordingly, polynucleotides related to this invention are useful as a marker in linkage analysis for chromosome 8. The translation product of this gene shares limited sequence homology with collagen proline rich domain.

This gene is expressed primarily in CNS.

Therefore, polynucleotides and polypeptides of the invention are useful as reagents for differential identification of the tissue(s) or cell type(s) present in a biological sample and for diagnosis of diseases and conditions which include, but are not limited to, neurological diseases. Similarly, polypeptides and antibodies directed to these polypeptides are useful in providing immunological probes for differential identification of the tissue(s) or cell type(s). For a number of disorders of the above tissues or cells, particularly of the nervous system, expression of this gene at significantly higher or lower levels may be routinely detected in certain tissues or cell types (e.g. CNS, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 448 as residues: Pro-35 to Asp-41.

The tissue distribution in tissues of the central nervous system indicates that the protein product of this gene is useful for the diagnosis and treatment of neurological diseases and disorders, such as Alzheimers Disease, Parkinsons Disease, Huntingtons Disease, Tourette Syndrome, schizophrenia, mania, dementia, paranoia, obsessive compulsive disorder, panic disorder, learning disabilities, ALS, psychoses, autism, and altered bahaviors, including disorders in feeding, sleep patterns, balance, and perception. In addition, the gene or gene product may also play a role in the treatment and/or detection of developmental disorders associated with the developing embryo, or sexually-linked disorders. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:210 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 2096 of SEQ ID NO:210, b is an integer of 15 to 2110, where both a and b correspond to the positions of nucleotide residues shown in SEQ ID NO:210, and where b is greater than or equal to a+14.

Features of Protein Encoded by Gene No: 201

The translation product of this gene shares homology with a mammalian histone Hla protein. One embodiment for this gene is the polypeptide fragments comprising the following amino acid sequence: ARLNVGRESLKREMLK-SQGVKVSESPMGARHSSWPEGAAFCK-KVQGAQMQFPPRR (SEQ ID NO:1215), ARLN-VGRESLKREML (SEQ ID NO:1216), LKSQGVKVSESPMGARHSSW (SEQ ID NO:1217), AFCKKVQGAQMQFPPRR (SEQ ID NO:1218), and/or AFCKKVQGAQMQFPPRR (SEQ ID NO:1219). An additional embodiment is the polynucleotide fragments encoding these polypeptide fragments.(See Genbank Accession No. pir|S24178).

This gene is expressed primarily in neutrophils.

Therefore, polynucleotides and polypeptides of the invention are useful as reagents for differential identification of the tissue(s) or cell type(s) present in a biological sample and for diagnosis of diseases and conditions which include, but are not limited to, immune disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neutrophils indicates that the protein product of this gene is useful for the diagnosis and treatment of immune disorders. Since the gene is expressed in cells of lymphoid origin, the natural gene product may be involved in vital immune functions. Therefore it may be also used as an agent for immunological disorders including arthritis, asthma, immune deficiency diseases such as AIDS, and leukemia. Furthermore, expression of this gene product in neutrophils also strongly indicates a role for this protein in immune function and immune surveillance. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:211 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 924 of SEQ ID NO:211, b is an integer of 15 to 938, where both a and b correspond to the positions of nucleotide residues shown in SEQ ID NO:211, and where b is greater than or equal to a+14.

Features of Protein Encoded by Gene No: 202

This gene is expressed primarily in neutrophils.

Therefore, polynucleotides and polypeptides of the invention are useful as reagents for differential identification of the tissue(s) or cell type(s) present in a biological sample and for diagnosis of diseases and conditions which include, but are not limited to, immune disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neutrophils indicates that the protein product of this gene is useful for the diagnosis and treatment of immune disorders. Since the gene is expressed in cells of lymphoid origin, the natural gene product may be involved in immune functions. Therefore it may be also used as an agent for immunological disorders including arthritis, asthma, immune deficiency diseases such as AIDS, and leukemia. Furthermore, expression of this gene product in neutrophils also strongly indicates a role for this protein in immune function and immune surveillance. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:212 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1537 of SEQ ID NO:212, b is an integer of 15 to 1551, where both a and b correspond to the positions of nucleotide residues shown in SEQ ID NO:212, and where b is greater than or equal to a+14.

Features of Protein Encoded by Gene No: 203

This gene is expressed primarily in neutrophils.

Therefore, polynucleotides and polypeptides of the invention are useful as reagents for differential identification of the tissue(s) or cell type(s) present in a biological sample and for diagnosis of diseases and conditions which include, but are not limited to, infectious disorders, immune disorders, and cancers. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 451 as residues: Thr-31 to Lys-36.

The tissue distribution in neutrophils indicates that the protein product of this gene is useful for the diagnosis and treatment of infectious disorders, immune disorders, and cancers. Since the gene is expressed in cells of lymphoid origin, the natural gene product may be involved in immune functions. Therefore it may be also used as an agent for immunological disorders including arthritis, asthma, immune deficiency diseases such as AIDS, and leukemia. Expression of this gene product in neutrophils also strongly indicates a role for this protein in immune function and immune surveillance. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:213 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 983 of SEQ ID NO:213, b is an integer of 15 to 997, where both a and b correspond to the positions of nucleotide residues shown in SEQ ID NO:213, and where b is greater than or equal to a+14.

Features of Protein Encoded by Gene No: 204

The gene encoding the disclosed cDNA is thought to reside on chromosome 16. Accordingly, polynucleotides related to this invention are useful as a marker in linkage analysis for chromosome 16. The translation product of this gene shares sequence homology with lactate dehydrogenase, which is thought to be important in lactate metabolism.

This gene is expressed primarily in human tonsils, and to a lesser extent, in spleen, and neutrophils.

Therefore, polynucleotides and polypeptides of the invention are useful as reagents for differential identification of the tissue(s) or cell type(s) present in a biological sample and for diagnosis of diseases and conditions which include, but are not limited to, immune disorders, infectious disorders, and cancers. Similarly, polypeptides and antibodies directed to these polypeptides are useful in providing immunological probes for differential identification of the tissue(s) or cell type(s). For a number of disorders of the above tissues or cells, particularly of the immune disorders, infectious disorders, and cancers, expression of this gene at significantly higher or lower levels may be routinely detected in certain tissues or cell types (e.g. tonsils, immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 452 as residues: Gly-7 to Ser-12.

The tissue distribution in human tonsils, spleen, and neutrophils, combined with the homology to lactate dehydrogenase gene indicates that the protein product of this gene is useful for the diagnosis and treatment of immune disorders, infectious disorders, and cancers. Furthermore, expression of this gene product in tonsils indicates a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the gene or protein, as well as, antibodies directed against the protein may show utility as a tumor marker and/or immunotherapy targets for the above listed tissues. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:214 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1482 of SEQ ID NO:214, b is an integer of 15 to 1496, where both a and b correspond to the positions of nucleotide residues shown in SEQ ID NO:214, and where b is greater than or equal to a+14.

Features of Protein Encoded by Gene No: 205

The translation product of this gene shares sequence homology with Gcap1 protein which is developmentally regulated in brain. In specific embodiments, polypeptides of the invention comprise the following amino acid sequence: NFFFVCLFKSSLRLVNSSYTPILCVL (SEQ ID NO:1220). Polynucleotides encoding these polypeptides are also encompassed by the invention.The gene encoding the disclosed cDNA is thought to reside on chromosome 7. Accordingly, polynucleotides related to this invention are useful as a marker in linkage analysis for chromosome 7.

This gene is expressed primarily in placenta and endometrial tumors.

Therefore, polynucleotides and polypeptides of the invention are useful as reagents for differential identification of the tissue(s) or cell type(s) present in a biological sample and for diagnosis of diseases and conditions which include, but are not limited to, vasculogenesis/angiogenesis and tumorigenesis. Similarly, polypeptides and antibodies directed to these polypeptides are useful in providing immunological probes for differential identification of the tissue(s) or cell type(s). For a number of disorders of the above tissues or cells, particularly of the vascular system and tumors, expression of this gene at significantly higher or lower levels may be routinely detected in certain tissues or cell types (e.g. placental, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 453 as residues: Lys-9 to Gln-16.

The tissue distribution placenta and endometrial tumors, combined with the homology to Gcap1 protein indicates that the protein product of this gene is useful for the diagnosis and treatment of disorders or dysfunctions of the vascular system, which incude, but are not limited to atherosclerosis, hypertension, embolism, thrombosis, microvascular disease, aneurysm, or stroke, or tumorigenesis. Furthermore, the tissue distribution indicates that the protein product of this gene is useful for the diagnosis and/or treatment of disorders of the placenta. Specific expression within the placenta indicates that this gene product may play a role in the proper establishment and maintenance of placental function. Alternately, this gene product may be produced by the placenta and then transported to the embryo, where it may play a crucial role in the development and/or survival of the developing embryo or fetus. Expression of this gene product in a vascular-rich tissue such as the placenta also indicates that this gene product may be produced more generally in endothelial cells or within the circulation. In such instances, it may play more generalized roles in vascular function, such as in angiogenesis. It may also be produced in the vasculature and have effects on other cells within the circulation, such as hematopoietic cells. It may serve to promote the proliferation, survival, activation, and/or differentiation of hematopoietic cells, as well as other cells throughout the body.

Many polynucleotide sequences, such as EST sequences, are publicly available and accessible through sequence databases. Some of these sequences are related to SEQ ID NO:215 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1294 of SEQ ID NO:215, b is an integer of 15 to 1308, where both a and b correspond to the positions of nucleotide residues shown in SEQ ID NO:215, and where b is greater than or equal to a+14.

Features of Protein Encoded by Gene No: 206

The translation product of this gene shares sequence homology with a C. elegans protein of unknown function (F23B2.4 [*Caenorhabditis elegans*]). In specific embodiments, polypeptides of the invention comprise the following amino acid sequence: VQVLEQLTNNAVAESR-FNDAAYYYWMLSMQCLDIAQD (SEQ ID NO:1221), PAQKDTMLGKFYHFQRLAELYHGYHAIHRHTEDP (SEQ ID NO:1222), LAKQSKALGAYRLARHAYDKLR-GLYIP (SEQ ID NO:1223), ARFQKSIELGTLTIRAKPF-HDSEELVPLCYRCSTNN (SEQ ID NO:1224), PLLNNLGNVCINCRQPFIFSASSYDV-LHLVEFYLEEGITDEEAISLIDLEVLRP-KRDDRQLEICKQQLPDSCG (SEQ ID NO:1225) MPY-AQWLAENDRFEEAQKAFHKAGRQREA (SEQ ID NO:1226), and/or FSVHRPETLFNISRFLLHSLPKDTPS-GISKVKILFT (SEQ ID NO:1227). Polynucleotides encoding these polypeptides are also encompassed by the invention.

This gene is expressed primarily in testes.

Therefore, polynucleotides and polypeptides of the invention are useful as reagents for differential identification of the tissue(s) or cell type(s) present in a biological sample and for diagnosis of diseases and conditions which include, but are not limited to, male reproductive and endocrine disorders. Similarly, polypeptides and antibodies directed to these polypeptides are useful in providing immunological probes for differential identification of the tissue(s) or cell type(s). For a number of disorders of the above tissues or cells, particularly of the reproductive and endocrine systems, expression of this gene at significantly higher or lower levels may be routinely detected in certain tissues or cell types (e.g. testes, cancerous and wounded tissues) or bodily fluids (e.g., lymph, serum, seminal fluid, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in testes indicates that the protein product of this gene is useful for the treatment of male reproductive and endocrine disorders. Furthermore, the tissue distribution indicates that the protein product of this gene is useful for the treatment and diagnosis of conditions concerning proper testicular function (e.g. endocrine function, sperm maturation), as well as cancer. Therefore, this gene product is useful in the treatment of male infertility and/or impotence. This gene product is also useful in assays designed to identify binding agents, as such agents (antagonists) are useful as male contraceptive agents. Similarly, the protein is believed to be useful in the treatment and/or diagnosis of testicular cancer. The testes are also a site of active gene expression of transcripts that may be expressed, particularly at low levels, in other tissues of the body. Therefore, this gene product may be expressed in other specific tissues or organs where it may play related functional roles in other processes, such as hematopoiesis, inflammation, bone formation, and kidney function, to name a few possible target indications.

Many polynucleotide sequences, such as EST sequences, are publicly available and accessible through sequence databases. Some of these sequences are related to SEQ ID NO:216 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 1691 of SEQ ID NO:216, b is an integer of 15 to 1705, where both a and b correspond to the positions of nucleotide residues shown in SEQ ID NO:216, and where b is greater than or equal to a+14.

Features of Protein Encoded by Gene No: 207

This gene is expressed in fetal lung.

Therefore, polynucleotides and polypeptides of the invention are useful as reagents for differential identification of the tissue(s) or cell type(s) present in a biological sample and for diagnosis of diseases and conditions which include, but are not limited to, lung diseases such as cystic fibrosis. Similarly, polypeptides and antibodies directed to these polypeptides are useful in providing immunological probes for differential identification of the tissue(s) or cell type(s). For a number of disorders of the above tissues or cells, particularly of the respiratory system, expression of this gene at significantly higher or lower levels may be routinely detected in certain tissues or cell types (e.g. respiratory, cancerous and wounded tissues) or bodily fluids (e.g., serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred epitopes include those comprising a sequence shown in SEQ ID NO: 455 as residues: Tyr-49 to Cys-54.

The tissue distribution in fetal lung indicates that the protein product of this gene is useful for the detection and treatment of disorders associated with developing lungs, particularly in premature infants where the lungs are the last tissues to develop. The tissue distribution indicates that the protein product of this gene is useful for the diagnosis and intervention of lung tumors, since the gene may be involved in the regulation of cell division, particularly since it is expressed in fetal tissue. Protein, as well as, antibodies directed against the protein may show utility as a tumor marker and immunotherapy targets for the above listed tumors and tissues.

Many polynucleotide sequences, such as EST sequences, are publicly available and accessible through sequence databases. Some of these sequences are related to SEQ ID NO:217 and may have been publicly available prior to conception of the present invention. Preferably, such related polynucleotides are specifically excluded from the scope of the present invention. To list every related sequence is cumbersome. Accordingly, preferably excluded from the present invention are one or more polynucleotides comprising a nucleotide sequence described by the general formula of a–b, where a is any integer between 1 to 985 of SEQ ID NO:217, b is an integer of 15 to 999, where both a and b correspond to the positions of nucleotide residues shown in SEQ ID NO:217, and where b is greater than or equal to a+14.

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of First AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 1 | HLHDS67 | 97979 Mar. 27, 1997 | Uni-ZAP XR | 11 | 2526 | 427 | 2526 | 458 | 458 | 249 | 1 | 30 | 31 | 30 |
| 2 | HLHD258 | 97979 Mar. 27, 1997 | Uni-ZAP XR | 12 | 1131 | 1 | 1131 | 129 | 129 | 250 | 1 | 14 | 15 | 115 |

-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of First AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 3 | HLMMJ13 | 97979 Mar. 27, 1997 | Lambda ZAP II | 13 | 941 | 39 | 941 | 62 | 62 | 251 | 1 | 44 | 45 | 102 |
| 3 | HLMMJ13 | 97979 Mar. 27, 1997 | Lambda ZAP II | 218 | 941 | 39 | 941 | 245 | 245 | 456 | 1 | 35 | 36 | 41 |
| 4 | HLTE125 | 97979 Mar. 27, 1997 | Uni-ZAP XR | 14 | 843 | 1 | 843 | 155 | 155 | 252 | 1 | 19 | 20 | 42 |
| 5 | HMSJX24 | 97979 Mar. 27, 1997 | Uni-ZAP XR | 15 | 1018 | 1 | 1018 | 90 | 90 | 253 | 1 | 18 | 19 | 36 |
| 6 | HNFED65 | 97979 Mar. 27, 1997 | Uni-ZAP XR | 16 | 661 | 1 | 661 | 76 | 76 | 254 | 1 | 28 | 29 | 127 |
| 7 | HNHDX07 | 97979 Mar. 27, 1997 | Uni-ZAP XR | 17 | 553 | 1 | 553 | 106 | 106 | 255 | 1 | 23 | 24 | 66 |
| 8 | HNHGC82 | 97979 Mar. 27, 1997 | Uni-ZAP XR | 18 | 869 | 1 | 869 | 101 | 101 | 256 | 1 | 21 | 22 | 68 |
| 9 | HNHGO09 | 97979 Mar. 27, 1997 | Uni-ZAP XR | 19 | 959 | 1 | 959 | 176 | 176 | 257 | 1 | 21 | 22 | 43 |
| 10 | HOUBE18 | 97979 Mar. 27, 1997 | Uni-ZAP XR | 20 | 1446 | 1 | 1446 | 101 | 101 | 258 | 1 | 27 | 28 | 50 |
| 11 | HOUDL69 | 97979 Mar. 27, 1997 | Uni-ZAP XR | 21 | 1471 | 579 | 1460 | 692 | 692 | 259 | 1 | 31 | 32 | 42 |
| 12 | HPMFI71 | 97979 Mar. 27, 1997 | Uni-ZAP XR | 22 | 1402 | 242 | 1402 | 401 | 401 | 260 | 1 | 32 | 33 | 60 |
| 13 | HPMGQ55 | 97979 Mar. 27, 1997 | Uni-ZAP XR | 23 | 1047 | 1 | 1047 | 164 | 164 | 261 | 1 | 26 | 27 | 35 |
| 14 | HPQAC69 | 97979 Mar. 27, 1997 | Lambda ZAP II | 24 | 990 | 1 | 988 | 82 | 82 | 262 | 1 | 20 | 21 | 37 |
| 15 | HPTBB03 | 97979 Mar. 27, 1997 | Uni-ZAP XR | 25 | 1028 | 350 | 1173 | 398 | 398 | 263 | 1 | 29 | 30 | 210 |
| 16 | HPTWA66 | 97979 Mar. 27, 1997 | pBluescript | 26 | 1922 | 1381 | 1922 | 24 | 24 | 264 | 1 | 33 | 34 | 547 |
| 16 | HPTWA66 | 97979 Mar. 27, 1997 | pBluescript | 219 | 575 | 1 | 575 | 148 | 148 | 457 | 1 | 22 | 23 | 65 |
| 17 | HPTWC08 | 97979 Mar. 27, 1997 | pBluescript | 27 | 1951 | 1422 | 1874 | 219 | 219 | 265 | 1 | 19 | 20 | 299 |
| 18 | HRGCZ46 | 97979 Mar. 27, 1997 | Uni-ZAP XR | 28 | 3989 | 2635 | 3989 |  | 2748 | 266 | 1 | 16 | 17 | 39 |
| 19 | HSAVU34 | 97979 Mar. 27, 1997 | Uni-ZAP XR | 29 | 2735 | 2966 | 3735 | 272 | 272 | 267 | 1 | 30 | 31 | 594 |
| 19 | HSAVU34 | 97979 Mar. 27, 1997 | Uni-ZAP XR | 220 | 3018 | 1929 | 3018 | 26 | 26 | 458 | 1 | 1 | 2 | 156 |
| 20 | HSDFW61 | 97974 Apr. 4, 1997 209080 May 29, 1997 | Uni-ZAP XR | 30 | 1667 | 59 | 1625 | 138 | 138 | 268 | 1 | 32 | 33 | 130 |
| 21 | HSDGP60 | 97974 Apr. 4, 1997 209080 May 29, 1997 | Uni-ZAP XR | 31 | 1408 | 1 | 1408 | 285 | 285 | 269 | 1 |  |  | 20 |
| 22 | HSOAJ55 | 97974 Apr. 4, 1997 209080 May 29, 1997 | Uni-ZAP XR | 32 | 3186 | 2402 | 3186 | 302 | 302 | 270 | 1 | 43 | 44 | 159 |
| 22 | HSOAJ55 | 97974 Apr. 4, 1997 209080 May 29, 1997 | Uni-ZAP XR | 221 | 2031 | 1273 | 2031 | 1285 | 1285 | 459 | 1 | 29 | 30 | 30 |
| 23 | HSQEO84 | 97974 Apr. 4, 1997 209080 May 29, 1997 | Uni-ZAP XR | 33 | 971 | 13 | 971 | 91 | 91 | 271 | 1 | 19 | 20 | 218 |
| 23 | HSQEO84 | 97974 Apr. 4, 1997 209080 May 29, 1997 | Uni-ZAP XR | 222 | 968 | 8 | 968 | 86 | 86 | 460 | 1 | 20 | 21 | 56 |
| 24 | HSXAM05 | 97974 Apr. 4, 1997 209080 May 29, 1997 | Uni-ZAP XR | 34 | 1792 | 369 | 1792 | 470 | 470 | 272 | 1 | 26 | 27 | 49 |
| 25 | HSXAS67 | 97974 Apr. 4, 1997 209080 May 29, 1997 | Uni-ZAP XR | 35 | 896 | 1 | 896 | 96 | 96 | 273 | 1 | 32 | 33 | 121 |

-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of First AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 26 | HTDAF28 | 97974 Apr. 4, 1997 209080 May 29, 1997 | pSport1 | 36 | 912 | 1 | 912 | 38 | 38 | 274 | 1 | 22 | 23 | 87 |
| 27 | HTEGQ64 | 97974 Apr. 4, 1997 209080 May 29, 1997 | Uni-ZAP XR | 37 | 1382 | 67 | 1382 | 271 | 271 | 275 | 1 | | | 25 |
| 28 | HTGEU09 | 97974 Apr. 4, 1997 209080 May 29, 1997 | Uni-ZAP XR | 38 | 872 | 1 | 872 | 74 | 74 | 276 | 1 | 18 | 19 | 28 |
| 29 | HTOAM21 | 97974 Apr. 4, 1997 209080 May 29, 1997 | Uni-ZAP XR | 39 | 812 | 1 | 812 | 41 | 41 | 277 | 1 | 30 | 31 | 43 |
| 30 | HTPBW79 | 209511 Dec. 3, 1997 | Uni-ZAP XR | 40 | 1515 | 118 | 1507 | 302 | 302 | 278 | 1 | 24 | 25 | 362 |
| 30 | HTSEV09 | 97974 Apr. 4, 1997 209080 May 29, 1997 | pBluescript | 223 | 1404 | 1 | 1265 | 92 | 92 | 461 | 1 | 19 | 20 | 415 |
| 31 | HJPCD40 | 97974 Apr. 4, 1997 209080 May 29, 1997 | Uni-Zap XR | 41 | 704 | 22 | 704 | | 117 | 279 | 1 | 18 | 19 | 127 |
| 32 | HTWBY48 | 97974 Apr. 4, 1997 209080 May 29, 1997 | pSport1 | 42 | 1094 | 1 | 1094 | 32 | 32 | 280 | 1 | 34 | 35 | 53 |
| 33 | HTWCI46 | 97974 Apr. 4, 1997 209080 May 29, 1997 | pSport1 | 43 | 1821 | 892 | 1647 | 56 | 56 | 281 | 1 | 26 | 27 | 29 |
| 34 | HTXGI75 | 97974 Apr. 4, 1997 209080 May 29, 1997 | Uni-ZAP XR | 44 | 1024 | 30 | 1024 | | 167 | 282 | 1 | 20 | 21 | 25 |
| 35 | HWTBF59 | 97974 Apr. 4, 1997 209080 May 29, 1997 | Uni-ZAP XR | 45 | 983 | 779 | 983 | 85 | 85 | 283 | 1 | 30 | 31 | 221 |
| 35 | HWTBF59 | 97974 Apr. 4, 1997 209080 May 29, 1997 | Uni-ZAP XR | 224 | 707 | 488 | 707 | 514 | 514 | 462 | 1 | 41 | 42 | 64 |
| 36 | HADAE74 | 97974 Apr. 4, 1997 209080 May 29, 1997 | pSport1 | 46 | 2421 | 664 | 1587 | 2110 | 2110 | 284 | 1 | 33 | 34 | 40 |
| 37 | HAGFB60 | 97974 Apr. 4, 1997 209080 May 29, 1997 | Uni-ZAP XR | 47 | 840 | 1 | 840 | 97 | 97 | 285 | 1 | 30 | 31 | 48 |
| 38 | HATEF60 | 97974 Apr. 4, 1997 209080 May 29, 1997 | Uni-ZAP XR | 48 | 2432 | 1193 | 2246 | 1491 | 1491 | 286 | 1 | 17 | 18 | 51 |
| 39 | HBMSN25 | 97974 Apr. 4, 1997 209080 May 29, 1997 | Uni-ZAP XR | 49 | 1742 | 1165 | 1742 | 1207 | 1207 | 287 | 1 | 23 | 24 | 31 |
| 40 | HCDAR68 | 97974 Apr. 4, 1997 209080 May 29, 1997 | Uni-ZAP XR | 50 | 1487 | 181 | 1455 | 325 | 325 | 288 | 1 | 35 | 36 | 56 |
| 41 | HCE3J79 | 97974 Apr. 4, 1997 209080 May 29, 1997 | Uni-ZAP XR | 51 | 1328 | 251 | 1328 | 525 | 525 | 289 | 1 | | | 21 |

-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of First AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 42 | HMDAN54 | 97974 Apr. 4, 1997 209080 May 29, 1997 | Uni-ZAP XR | 52 | 1856 | 725 | 1853 | 928 | 928 | 290 | 1 | 33 | 34 | 50 |
| 43 | HCECA49 | 97974 Apr. 4, 1997 209080 May 29, 1997 | Uni-ZAP XR | 53 | 1558 | 310 | 1408 | 109 | 109 | 291 | 1 | 30 | 31 | 98 |
| 44 | HCEEC15 | 97974 Apr. 4, 1997 209080 May 29, 1997 | Uni-ZAP XR | 54 | 948 | 1 | 948 | 9 | 9 | 292 | 1 | 23 | 24 | 65 |
| 45 | HCESF40 | 97974 Apr. 4, 1997 209080 May 29, 1997 | pBluescript | 225 | 1384 | 99 | 1384 | 193 | 193 | 463 | 1 | 32 | 33 | 205 |
| 46 | HCFMV39 | 97974 Apr. 4, 1997 209080 May 29, 1997 | pSport1 | 56 | 1603 | 1 | 1296 | 96 | 96 | 294 | 1 | 29 | 30 | 102 |
| 47 | HCMSX86 | 97975 Apr. 4, 1997 209081 May 29, 1997 | Uni-ZAP XR | 57 | 1052 | 5 | 786 | 12 | 12 | 295 | 1 | 28 | 29 | 32 |
| 48 | HCNAP62 | 97975 Apr. 4, 1997 209081 May 29, 1997 | Lambda ZAP II | 58 | 814 | 1 | 558 | 93 | 93 | 296 | 1 | 22 | 23 | 42 |
| 49 | HCRAF32 | 97975 Apr. 4, 1997 209081 May 29, 1997 | Uni-ZAP XR | 59 | 1215 | 257 | 1215 | | 356 | 297 | 1 | 19 | 20 | 20 |
| 50 | HCUDC07 | 97975 Apr. 4, 1997 209081 May 29, 1997 | ZAP Express | 60 | 478 | 1 | 478 | 147 | 147 | 298 | 1 | 36 | 37 | 69 |
| 51 | HCWBB42 | 97975 Apr. 4, 1997 209081 May 29, 1997 | ZAP Express | 61 | 618 | 1 | 618 | 212 | 212 | 299 | 1 | 35 | 36 | 74 |
| 52 | HDTAB05 | 97975 Apr. 4, 1997 209081 May 29, 1997 | pCMVSport 2.0 | 62 | 751 | 1 | 751 | 257 | 257 | 300 | 1 | 21 | 22 | 32 |
| 53 | HE2AV74 | 97975 Apr. 4, 1997 209081 May 29, 1997 | Uni-ZAP XR | 63 | 780 | 283 | 780 | | 433 | 301 | 1 | | | 16 |
| 54 | HE2AY71 | 97975 Apr. 4, 1997 209081 May 29, 1997 | Uni-ZAP XR | 64 | 588 | 21 | 588 | 169 | 169 | 302 | 1 | | | 16 |
| 55 | HE2GS36 | 97975 Apr. 4, 1997 209081 May 29, 1997 | Uni-ZAP XR | 65 | 945 | 1 | 349 | 520 | 520 | 303 | 1 | 39 | 40 | 111 |
| 55 | HE2GS36 | 97975 Apr. 4, 1997 209081 May 29, 1997 | Uni-ZAP XR | 226 | 774 | 272 | 774 | 445 | 445 | 464 | 1 | | | 37 |
| 56 | HE2OF09 | 97975 Apr. 4, 1997 209081 May 29, 1997 | Uni-ZAP XR | 66 | 1866 | 1313 | 1866 | 1596 | 1596 | 304 | 1 | | | 11 |
| 57 | HE6EU50 | 97975 Apr. 4, 1997 209081 May 29, 1997 | Uni-ZAP XR | 67 | 1152 | 117 | 686 | 237 | 237 | 305 | 1 | 20 | 21 | 34 |
| 58 | HE9HU17 | 97975 Apr. 4, 1997 209081 May 29, 1997 | Uni-ZAP XR | 68 | 2483 | 1577 | 2448 | 1620 | 1620 | 306 | 1 | | | 14 |

-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of First AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 59 | HE9ND48 | 97975 Apr. 4, 1997 209081 May 29, 1997 | Uni-ZAP XR | 69 | 536 | 1 | 536 | 83 | 83 | 307 | 1 | 36 | 37 | 43 |
| 60 | HEBBW11 | 97975 Apr. 4, 1997 209081 May 29, 1997 | Uni-ZAP XR | 70 | 574 | 97 | 564 | 109 | 109 | 308 | 1 | 55 | 56 | 137 |
| 60 | HEBBW11 | 97975 Apr. 4, 1997 209081 May 29, 1997 | Uni-ZAP XR | 227 | 865 | 647 | 865 |  | 388 | 465 | 1 | 30 | 31 | 135 |
| 61 | HELDY74 | 97975 Apr. 4, 1997 209081 May 29, 1997 | Uni-ZAP XR | 71 | 932 | 1 | 932 | 201 | 201 | 309 | 1 | 17 | 18 | 33 |
| 62 | HEMAE80 | 97975 Apr. 4, 1997 209081 May 29, 1997 | Uni-ZAP XR | 72 | 996 | 1 | 945 | 12 | 12 | 310 | 1 | 24 | 25 | 136 |
| 63 | HFEBA88 | 97975 Apr. 4, 1997 209081 May 29, 1997 | Uni-ZAP XR | 73 | 785 | 464 | 785 | 356 | 356 | 311 | 1 | 29 | 30 | 57 |
| 64 | HFGAB89 | 97975 Apr. 4, 1997 209081 May 29, 1997 | Uni-ZAP XR | 74 | 1069 | 196 | 1047 | 295 | 295 | 312 | 1 | 32 | 33 | 34 |
| 65 | HFVHY45 | 97975 Apr. 4, 1997 209081 May 29, 1997 | pBluescript | 75 | 831 | 1 | 831 | 50 | 50 | 313 | 1 | 36 | 37 | 89 |
| 66 | HGBAJ93 | 97975 Apr. 4, 1997 209081 May 29, 1997 | Uni-ZAP XR | 76 | 590 | 1 | 590 | 233 | 233 | 314 | 1 | 38 | 39 | 94 |
| 67 | HGBBQ69 | 97975 Apr. 4, 1997 209081 May 29, 1997 | Uni-ZAP XR | 77 | 1274 | 1 | 1273 | 105 | 105 | 315 | 1 | 24 | 25 | 43 |
| 68 | HHFCF08 | 97975 Apr. 4, 1997 209081 May 29, 1997 | Uni-ZAP XR | 78 | 1133 | 4 | 1042 | 175 | 175 | 316 | 1 | 23 | 24 | 30 |
| 69 | HHFHJ59 | 97975 Apr. 4, 1997 209081 May 29, 1997 | Uni-ZAP XR | 79 | 661 | 1 | 661 | 192 | 192 | 317 | 1 | 29 | 30 | 112 |
| 70 | HHFHR32 | 97975 Apr. 4, 1997 209081 May 29, 1997 | Uni-ZAP XR | 80 | 1378 | 1 | 1378 | 58 | 58 | 318 | 1 | 25 | 26 | 235 |
| 71 | HHGCN69 | 97975 Apr. 4, 1997 209081 May 29, 1997 | Lambda ZAP II | 81 | 1440 | 298 | 1440 | 532 | 532 | 319 | 1 | 23 | 24 | 34 |
| 72 | HHGDO13 | 97975 Apr. 4, 1997 209081 May 29, 1997 | Lambda ZAP II | 82 | 1381 | 766 | 1371 | 993 | 993 | 320 | 1 | 23 | 24 | 34 |
| 73 | HHPFD63 | 97975 Apr. 4, 1997 209081 May 29, 1997 | Uni-ZAP XR | 83 | 1706 | 182 | 1644 | 257 | 257 | 321 | 1 | 24 | 25 | 81 |
| 74 | HHSEG23 | 97976 Apr. 4, 1997 | Uni-ZAP XR | 84 | 573 | 1 | 573 | 160 | 160 | 322 | 1 | 18 | 19 | 71 |
| 75 | HIPAV06 | 97976 Apr. 4, 1997 | Uni-ZAP XR | 85 | 684 | 199 | 684 | 323 | 323 | 323 | 1 | 27 | 28 | 33 |
| 76 | HKIXL73 | 97976 Apr. 4, 1997 | pBluescript | 86 | 1036 | 591 | 1036 | 690 | 690 | 324 | 1 | 32 | 33 | 114 |
| 77 | HKMNC43 | 97976 Apr. 4, 1997 | pBluescript | 87 | 08 | 1 | 08 | 139 | 139 | 325 | 1 | 18 | 19 | 108 |

-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of First AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 78 | HMEJE31 | 97976 Apr. 4, 1997 | Lambda ZAP II | 88 | 655 | 1 | 655 | 165 | 165 | 326 | 1 | 33 | 34 | 64 |
| 79 | HMSKS35 | 97976 Apr. 4, 1997 | Uni-ZAP XR | 89 | 1102 | 1 | 1102 | 228 | 228 | 327 | 1 | 23 | 24 | 49 |
| 79 | HMSKS35 | 97976 Apr. 4, 1997 | Uni-ZAP XR | 228 | 1102 | 1 | 1102 | 228 | 228 | 466 | 1 | 26 | 27 | 49 |
| 80 | HNFAE54 | 97976 Apr. 4, 1997 | Uni-ZAP XR | 90 | 1533 | 665 | 1518 | 347 | 347 | 328 | 1 | 26 | 27 | 293 |
| 81 | HNFJH45 | 97976 Apr. 4, 1997 | Uni-ZAP XR | 91 | 575 | 1 | 575 | 275 | 275 | 329 | 1 | 30 | 31 | 67 |
| 82 | HNGBT31 | 97976 Apr. 4, 1997 | Uni-ZAP XR | 92 | 639 | 1 | 639 | 224 | 224 | 330 | 1 | 28 | 29 | 104 |
| 83 | HNGJN60 | 97976 Apr. 4, 1997 | Uni-ZAP XR | 93 | 858 | 1 | 858 | 239 | 239 | 331 | 1 | 23 | 24 | 58 |
| 83 | HNGJG84 | 97976 Apr. 4, 1997 | Uni-ZAP XR | 229 | 744 | 1 | 744 | 225 | 225 | 467 | 1 | 43 | 44 | 70 |
| 84 | HNGJG84 | 97976 Apr. 4, 1997 | Uni-ZAP XR | 94 | 526 | 1 | 526 | 268 | 268 | 332 | 1 | 29 | 30 | 38 |
| 85 | HNHDW42 | 97976 Apr. 4, 1997 | Uni-ZAP XR | 95 | 426 | 1 | 426 | 168 | 168 | 333 | 1 | 28 | 29 | 71 |
| 86 | HNHFL57 | 97976 Apr. 4, 1997 | Uni-ZAP XR | 96 | 844 | 1 | 844 | 98 | 98 | 334 | 1 | 25 | 26 | 61 |
| 87 | HOGAR52 | 97977 Apr. 4, 1997 209082 May 29, 1997 | pCMVSport 2.0 | 97 | 1985 | 453 | 1985 | 533 | 533 | 335 | 1 | 17 | 18 | 285 |
| 88 | HOSBZ55 | 97977 Apr. 4, 1997 209082 May 29, 1997 | Uni-ZAP XR | 98 | 1416 | 69 | 1416 | 246 | 246 | 336 | 1 | 32 | 33 | 54 |
| 89 | HOSDI92 | 9799 Apr. 4, 1997 209082 May 29, 1997 | Uni-ZAP XR | 99 | 1760 | 1469 | 1760 | 934 | 934 | 337 | 1 | 22 | 23 | 59 |
| 89 | HOSDJ92 | 97977 Apr. 4, 1997 209082 May 29, 1997 | Uni-ZAP XR | 230 | 1935 | 141 | 772 | | 274 | 468 | 1 | 20 | 21 | 58 |
| 90 | HPBCU51 | 97977 Apr. 4, 1997 209082 May 29, 1997 | pBluescript SK- | 100 | 599 | 1 | 599 | 86 | 86 | 338 | 1 | 27 | 28 | 119 |
| 91 | HPCAL49 | 97977 Apr. 4, 1997 209082 May 29, 1997 | Uni-ZAP XR | 101 | 784 | 1 | 784 | 113 | 113 | 339 | 1 | 36 | 37 | 38 |
| 92 | HPFCR13 | 97977 Apr. 4, 1997 209082 May 29, 1997 | Uni-ZAP XR | 102 | 404 | 1 | 404 | 266 | 266 | 340 | 1 | 30 | 31 | 46 |
| 92 | HPFCR13 | 97977 Apr. 4, 1997 209082 May 29, 1997 | Uni-ZAP XR | 231 | 1035 | 602 | 1035 | 859 | 859 | 469 | 1 | 32 | 33 | 58 |
| 93 | HPHAC83 | 97977 Apr. 4, 1997 209082 May 29, 1997 | Uni-ZAP XR | 103 | 2218 | 840 | 2182 | 1035 | 1035 | 341 | 1 | 17 | 18 | 17 |
| 93 | HOFNZ45 | 209568 Jan. 6, 1998 | pCMVSport 2.0 | 232 | 760 | 1 | 728 | 86 | 86 | 470 | 1 | 36 | 37 | 61 |
| 94 | HPMBQ32 | 97977 Apr. 4, 1997 209082 May 29, 1997 | Uni-ZAP XR | 104 | 1351 | 1 | 1351 | 18 | 18 | 342 | 1 | 23 | 24 | 86 |
| 95 | HPWAN23 | 97977 Apr. 4, 1997 209082 May 29, 1997 | Uni-ZAP XR | 105 | 2066 | 51 | 2052 | 270 | 270 | 343 | 1 | 29 | 30 | 537 |
| 95 | HPWAN23 | 97977 Apr. 4, 1997 209082 May 29, 1997 | Uni-ZAP XR | 233 | 2057 | 1 | 1954 | 220 | 220 | 471 | 1 | 29 | 30 | 315 |

-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of First AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 96 | HRDFB85 | 97977 Apr. 4, 1997 209082 May 29, 1997 | Uni-ZAP XR | 106 | 1705 | 23 | 1697 | 233 | 233 | 344 | 1 | 21 | 22 | 201 |
| 97 | HRGBR28 | 97977 Apr. 4, 1997 209082 May 29, 1997 | Uni-ZAP XR | 107 | 1167 | 1 | 557 | 604 | 604 | 345 | 1 | 22 | 23 | 122 |
| 98 | HSKGN81 | 97977 Apr. 4, 1997 209082 May 29, 1997 | pBluescript | 108 | 1907 | 151 | 1432 | 353 | 353 | 346 | 1 | 23 | 24 | 260 |
| 98 | HSKGN81 | 97977 Apr. 4, 1997 209082 May 29, 1997 | pBluescript | 234 | 2084 | 335 | 2084 | 537 | 537 | 472 | 1 | 19 | 20 | 23 |
| 99 | HSPAH56 | 97977 Apr. 4, 1997 209082 May 29, 1997 | pSport1 | 109 | 611 | 1 | 576 | 229 | 229 | 347 | 1 | 25 | 26 | 47 |
| 100 | HE8EU04 | 209746 Apr. 7, 1998 | Uni-ZAP XR | 110 | 2632 | 294 | 2632 | 337 | 337 | 348 | 1 | 25 | 26 | 333 |
| 100 | HSXBT86 | 97977 Apr. 4, 1997 209082 May 29, 1997 | Uni-ZAP XR | 235 | 2143 | 53 | 1096 | 235 | 235 | 473 | 1 | | | 9 |
| 101 | HSXCS62 | 97977 Apr. 4, 1997 209082 May 29, 1997 | Uni-ZAP XR | 111 | 2249 | 1 | 1953 | 90 | 90 | 349 | 1 | 18 | 19 | 199 |
| 102 | HTEFU09 | 97977 Apr. 4, 1997 209082 May 29, 1997 | Uni-ZAP XR | 112 | 2198 | 228 | 2158 | 400 | 400 | 350 | 1 | | | 23 |
| 103 | HTEKM35 | 97977 Apr. 4, 1997 209082 May 29, 1997 | Uni-ZAP XR | 113 | 1043 | 40 | 1043 | 320 | 320 | 351 | 1 | 20 | 21 | 142 |
| 104 | HTGEP89 | 97977 Apr. 4, 1997 209082 May 29, 1997 | Uni-ZAP XR | 114 | 703 | 1 | 703 | 285 | 285 | 352 | 1 | 29 | 30 | 94 |
| 105 | HTGEW91 | 97977 Apr. 4, 1997 209082 May 29, 1997 | Uni-ZAP XR | 115 | 3684 | 526 | 1338 | 584 | 584 | 353 | 1 | 24 | 25 | 37 |
| 106 | HTOEY16 | 97977 Apr. 4, 1997 209082 May 29, 1997 | Uni-ZAP XR | 116 | 1965 | 127 | 1915 | 202 | 202 | 354 | 1 | 27 | 28 | 38 |
| 107 | HTPCN79 | 97977 Apr. 4, 1997 209082 May 29, 1997 | Uni-ZAP XR | 117 | 503 | 1 | 503 | | 1 | 355 | 1 | 7 | 8 | 70 |
| 108 | HTSGM54 | 97977 Apr. 4, 1997 209082 May 29, 1997 | pBluescript | 118 | 1071 | 50 | 981 | 29 | 29 | 356 | 1 | 30 | 31 | 227 |
| 108 | HTSGM54 | 97977 Apr. 4, 1997 209082 May 29, 1997 | pBluescript | 236 | 1133 | 316 | 1069 | | 423 | 474 | 1 | 12 | 13 | 84 |
| 109 | HTSHE40 | 97977 Apr. 4, 1997 209082 May 29, 1997 | pBluescript | 119 | 1101 | 118 | 956 | 218 | 218 | 357 | 1 | 31 | 32 | 89 |
| 110 | HTWAF58 | 97977 Apr. 4, 1997 209082 May 29, 1997 | Lambda ZAP II | 120 | 282 | 1 | 282 | 137 | 137 | 358 | 1 | 25 | 26 | 48 |

-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of First AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 111 | HTWBY29 | 97977 Apr. 4, 1997 | pSport1 | 121 | 2635 | 1593 | 2489 | 1654 | 1654 | 359 | 1 | 25 | 26 | 55 |
| 112 | HUKFC71 | 209082 May 29, 1997 209007 Apr. 28, 1997 | Lambda ZAP II | 122 | 994 | 1 | 932 | | 272 | 360 | 1 | 15 | 16 | 221 |
| 113 | HCE3Q10 | 209083 May 29, 1997 209007 Apr. 28, 1997 | Uni-ZAP XR | 123 | 1542 | 1 | 1542 | 143 | 143 | 361 | 1 | 25 | 26 | 63 |
| 114 | HCEVR60 | 209083 May 29, 1997 209007 Apr. 28, 1997 | Uni-ZAP XR | 124 | 1390 | 82 | 1390 | 127 | 127 | 362 | 1 | 32 | 33 | 153 |
| 115 | HDTAW95 | 209083 May 29, 1997 209007 Apr. 28, 1997 | pCMVSport 2.0 | 125 | 1288 | 412 | 1288 | 571 | 571 | 363 | 1 | | | 16 |
| 116 | HE6EL90 | 209083 May 29, 1997 209007 Apr. 28, 1997 | Uni-ZAP XR | 126 | 1517 | 1 | 1452 | 243 | 243 | 364 | 1 | | | 9 |
| 117 | HELBU29 | 209083 May 29, 1997 209007 Apr. 28, 1997 | Uni-ZAP XR | 127 | 1073 | 198 | 1073 | | 776 | 365 | 1 | | | 13 |
| 118 | HERAH36 | 209083 May 29, 1997 209007 Apr. 28, 1997 | Uni-ZAP XR | 128 | 300 | 155 | 300 | 202 | 202 | 366 | 1 | | | 17 |
| 119 | HFXBW82 | 209083 May 29, 1997 209007 Apr. 28, 1997 | Lambda ZAP II | 129 | 1275 | 1 | 1275 | 56 | 56 | 367 | 1 | 23 | 24 | 61 |
| 120 | HHPTD20 | 209083 May 29, 1997 209007 Apr. 28, 1997 | Uni-ZAP XR | 130 | 472 | 51 | 472 | | 243 | 368 | 1 | | | 32 |
| 121 | HIBED17 | 209083 May 29, 1997 209007 Apr. 28, 1997 | Other | 131 | 1950 | 284 | 1927 | 395 | 395 | 369 | 1 | 72 | 73 | 245 |
| 122 | HLTER03 | 209083 May 29, 1997 209007 Apr. 28, 1997 | Uni-ZAP XR | 132 | 990 | 1 | 990 | 78 | 78 | 370 | 1 | 22 | 23 | 34 |
| 123 | HOABL56 | 209083 May 29, 1997 209007 Apr. 28, 1997 | Uni-ZAP XR | 133 | 1720 | 565 | 1720 | 660 | 660 | 371 | 1 | 18 | 19 | 21 |
| 124 | HPMCJ92 | 209083 May 29, 1997 209007 Apr. 28, 1997 | Uni-ZAP XR | 134 | 705 | 28 | 705 | 106 | 106 | 372 | 1 | 28 | 29 | 98 |
| 125 | HPWAZ95 | 209083 May 29, 1997 209007 Apr. 28, 1997 | Uni-ZAP XR | 135 | 323 | 1 | 323 | 88 | 88 | 373 | 1 | 27 | 28 | 78 |
| 126 | HRGBR18 | 209083 May 29, 1997 209007 Apr. 28, 1997 | Uni-ZAP XR | 136 | 582 | 1 | 582 | | 16 | 374 | 1 | 17 | 18 | 30 |
| 127 | HSUBW09 | 209083 May 29, 1997 209007 Apr. 28, 1997 | Uni-ZAP XR | 137 | 1021 | 1 | 1021 | 153 | 153 | 375 | 1 | 32 | 33 | 56 |
| 128 | HUKCO64 | 209083 May 29, 1997 209007 Apr. 28, 1997 209083 May 29, 1997 | Lambda ZAP II | 138 | 1777 | 1 | 1339 | 198 | 198 | 376 | 1 | 23 | 24 | 63 |

-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of First AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 129 | H6EAA53 | 209007 Apr. 28, 1997 209083 May 29, 1997 | Uni-ZAP XR | 139 | 643 | 303 | 643 | 306 | 306 | 377 | 1 | 14 | 15 | 38 |
| 130 | HAGAI11 | 209007 Apr. 28, 1997 209083 May 29, 1997 | Uni-ZAP XR | 140 | 1220 | 1 | 1220 | 567 | 567 | 378 | 1 | 50 | 51 | 98 |
| 131 | HAGAO39 | 209007 Apr. 28, 1997 209083 May 29, 1997 | Uni-ZAP XR | 141 | 721 | 1 | 721 | | 415 | 379 | 1 | | | 14 |
| 132 | HALSK07 | 209007 Apr. 28, 1997 209083 May 29, 1997 | Uni-ZAP XR | 142 | 1468 | 125 | 1468 | 210 | 210 | 380 | 1 | 29 | 30 | 33 |
| 133 | HALSQ59 | 209007 Apr. 28, 1997 209083 May 29, 1997 | Uni-ZAP XR | 143 | 300 | 4 | 300 | 101 | 101 | 381 | 1 | 22 | 23 | 66 |
| 134 | HAIBP89 | 209877 05/18/98 | Uni-ZAP XR | 144 | 2243 | 173 | 2243 | 311 | 311 | 382 | 1 | 27 | 28 | 317 |
| 134 | HBGCB91 | 209007 Apr. 28, 1997 209083 May 29, 1997 | Uni-ZAP XR | 237 | 1025 | 409 | 1025 | 624 | 624 | 475 | 1 | 20 | 21 | 25 |
| 135 | HBMTD81 | 209008 Apr. 28, 1997 209084 May 29, 1997 | Uni-ZAP XR | 145 | 1082 | 163 | 1082 | 357 | 357 | 383 | 1 | | | 30 |
| 136 | HBXGK12 | 209008 Apr. 28, 1997 209084 May 29, 1997 | ZAP Express | 146 | 4313 | 1153 | 4313 | 1313 | 1313 | 384 | 1 | 18 | 19 | 42 |
| 137 | HFKFJ07 | 209010 Apr. 28, 1997 209085 May 29, 1997 | Uni-ZAP XR | 147 | 1183 | 1 | 1183 | 149 | 149 | 385 | 1 | 41 | 42 | 254 |
| 138 | HCQAI40 | 209008 Apr. 28, 1997 209084 May 29, 1997 | Lambda ZAP II | 148 | 734 | 1 | 734 | 285 | 285 | 386 | 1 | | | 19 |
| 139 | HCWHZ24 | 2090087 Apr. 28, 1997 209084 May 29, 1997 | ZAP Express | 149 | 1405 | 1 | 1405 | 108 | 108 | 387 | 1 | 34 | 35 | 63 |
| 140 | HE2GT20 | 209008 Apr. 28, 1997 209084 May 29, 1997 | Uni-ZAP XR | 150 | 2890 | 1178 | 2890 | 1178 | 1178 | 388 | 1 | 31 | 32 | 39 |
| 141 | HE8EY43 | 209008 Apr. 28, 1997 209084 May 29, 1997 | Uni-ZAP XR | 151 | 2399 | 1181 | 2399 | 1265 | 1265 | 389 | 1 | 30 | 31 | 34 |
| 142 | HFCEB37 | 209008 Apr. 28, 1997 209084 May 29, 1997 | Uni-ZAP XR | 152 | 802 | 352 | 802 | | 487 | 390 | 1 | | | 10 |
| 143 | HFTCT67 | 209008 Apr. 28, 1997 209084 May 29, 1997 | Uni-ZAP XR | 153 | 461 | 24 | 461 | 145 | 145 | 391 | 1 | 37 | 38 | 63 |
| 144 | HGLAM46 | 209008 Apr. 28, 1997 209084 May 29, 1997 | Uni-ZAP XR | 154 | 2388 | 818 | 2388 | 648 | 648 | 392 | 1 | | | 18 |
| 145 | HHGBR15 | 209008 Apr. 28, 1997 209084 May 29, 1997 | Lambda ZAP II | 155 | 642 | 322 | 642 | 369 | 369 | 393 | 1 | 41 | 42 | 43 |

-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of First AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 146 | HJAAU36 | 209008 Apr. 28, 1997 209084 May 29, 1997 | pBluescript SK- | 156 | 1251 | 583 | 1251 | | 933 | 394 | 1 | 16 | 17 | 16 |
| 147 | HUSIT49 | 209008 Apr. 28, 1997 209084 May 29, 1997 | pSport1 | 157 | 2127 | 247 | 2127 | 383 | 383 | 395 | 1 | 47 | 48 | 83 |
| 148 | HKLAB16 | 209008 Apr. 28, 1997 209084 May 29, 1997 | Lambda ZAP II | 158 | 1625 | 817 | 1625 | 1012 | 1012 | 396 | 1 | 18 | 19 | 20 |
| 149 | HLMMU76 | 209008 Apr. 28, 1997 209084 May 29, 1997 | Lambda ZAP II | 159 | 1687 | 1307 | 1687 | 1296 | 1296 | 397 | 1 | 28 | 29 | 28 |
| 150 | HMSKQ35 | 209008 Apr. 28, 1997 209084 May 29, 1997 | Uni-ZAP XR | 160 | 1842 | 172 | 1463 | 319 | 319 | 398 | 1 | 30 | 31 | 33 |
| 151 | HNHED86 | 209008 Apr. 28, 1997 209084 May 29, 1997 | Uni-ZAP XR | 161 | 770 | 1 | 770 | 30 | 30 | 399 | 1 | 31 | 32 | 46 |
| 152 | HNHEJ88 | 209008 Apr. 28, 1997 209084 May 29, 1997 | Uni-ZAP XR | 162 | 519 | 1 | 519 | 242 | 242 | 400 | 1 | 17 | 18 | 24 |
| 153 | HNHFQ63 | 209008 Apr. 28, 1997 209084 May 29, 1997 | Uni-ZAP XR | 163 | 753 | 1 | 753 | 164 | 164 | 401 | 1 | 17 | 18 | 67 |
| 154 | HOECU83 | 209009 Apr. 28, 1997 | Uni-ZAP XR | 164 | 1893 | 1 | 1211 | 1637 | 1637 | 402 | 1 | 28 | 29 | 85 |
| 154 | HOECU83 | 209009 Apr. 28, 1997 | Uni-ZAP XR | 238 | 1400 | 189 | 1400 | | 508 | 476 | 1 | 22 | 23 | 33 |
| 155 | HPTRC15 | 209009 Apr. 28, 1997 | pBluescript | 165 | 2153 | 594 | 2153 | 57 | 57 | 403 | 1 | 26 | 27 | 82 |
| 156 | HSKCP69 | 209009 Apr. 28, 1997 | Uni-ZAP XR | 166 | 1251 | 219 | 1120 | 49 | 49 | 404 | 1 | 27 | 28 | 286 |
| 156 | HSKCP69 | 209009 Apr. 28, 1997 | Uni-ZAP XR | 239 | 1250 | 223 | 1250 | 393 | 393 | 477 | 1 | 32 | 33 | 171 |
| 157 | H6EAE26 | 209009 Apr. 28, 1997 | Uni-ZAP XR | 167 | 882 | 48 | 882 | 155 | 155 | 405 | 1 | 33 | 34 | 153 |
| 158 | HAGBX03 | 209009 Apr. 28, 1997 | Uni-ZAP XR | 168 | 1208 | 1 | 1208 | 290 | 290 | 406 | 1 | 20 | 21 | 37 |
| 159 | HAGDQ47 | 209009 Apr. 28, 1997 | Uni-ZAP XR | 169 | 1258 | 1 | 1258 | 44 | 44 | 407 | 1 | 22 | 23 | 60 |
| 159 | HAGDQ47 | 209009 Apr. 28, 1997 | Uni-ZAP XR | 240 | 1307 | 1 | 1307 | 44 | 44 | 478 | 1 | 22 | 23 | 60 |
| 160 | HAICP19 | 209009 Apr. 28, 1997 | Uni-ZAP XR | 170 | 1624 | 89 | 1483 | 128 | 128 | 408 | 1 | 18 | 19 | 446 |
| 161 | HAUAE83 | 209009 Apr. 28, 1997 | Uni-ZAP XR | 171 | 2003 | 889 | 2003 | 957 | 957 | 409 | 1 | 29 | 30 | 64 |
| 162 | HBHAD12 | 209009 Apr. 28, 1997 | Uni-ZAP XR | 172 | 786 | 1 | 786 | | 176 | 410 | 1 | 17 | 18 | 23 |
| 163 | HBMTY28 | 209009 Apr. 28, 1997 | Uni-ZAP XR | 173 | 1758 | 962 | 1758 | 1184 | 1184 | 411 | 1 | 27 | 28 | 34 |
| 164 | HBMVP04 | 209009 Apr. 28, 1997 | Uni-ZAP XR | 174 | 1369 | 29 | 557 | 947 | 947 | 412 | 1 | 33 | 34 | 41 |
| 164 | HBMVP04 | 209009 Apr. 28, 1997 | Uni-ZAP XR | 241 | 888 | 330 | 862 | | 546 | 479 | 1 | | | 2 |
| 165 | HCDDB78 | 209009 Apr. 28, 1997 | Uni-ZAP XR | 175 | 2379 | 750 | 2379 | 901 | 901 | 413 | 1 | 18 | 19 | 24 |
| 166 | HCEQA68 | 209010 Apr. 28, 1997 209085 May 29, 1997 | Uni-ZAP XR | 176 | 1348 | 1 | 1348 | 12 | 12 | 414 | 1 | 28 | 29 | 78 |
| 167 | HCEZS40 | 209010 Apr. 28, 1997 209085 May 29, 1997 | Uni-ZAP XR | 177 | 1502 | 178 | 1502 | 388 | 388 | 415 | 1 | 31 | 32 | 51 |

-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of First AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 168 | HCFNF11 | 209010 Apr. 28, 1997 209085 May 29, 1997 | pSport1 | 178 | 1637 | 26 | 1607 | 152 | 152 | 416 | 1 | 44 | 45 | 257 |
| 169 | HCRBL20 | 209010 Apr. 28, 1997 209085 May 29, 1997 | Uni-ZAP XR | 179 | 2911 | 1103 | 2858 | 192 | 192 | 417 | 1 | 32 | 33 | 424 |
| 169 | HCRBL20 | 209010 Apr. 28, 1997 209085 May 29, 1997 | Uni-ZAP XR | 242 | 1811 | 20 | 1811 | 93 | 93 | 480 | 1 | 36 | 37 | 95 |
| 170 | HCUBL62 | 209010 Apr. 28, 1997 209085 May 29, 1997 | ZAP Express | 180 | 519 | 1 | 519 | 57 | 57 | 418 | 1 | 28 | 29 | 32 |
| 171 | HDSAP81 | 209010 Apr. 28, 1997 209085 May 29, 1997 | Uni-ZAP XR | 181 | 968 | 320 | 968 | 476 | 476 | 419 | 1 | 27 | 28 | 79 |
| 172 | HE2CT29 | 209010 Apr. 28, 1997 209085 May 29, 1997 | Uni-ZAP XR | 182 | 1128 | 1 | 1128 | 111 | 111 | 420 | 1 | 26 | 27 | 94 |
| 173 | HE8MG65 | 209010 Apr. 28, 1997 209085 May 29, 1997 | Uni-ZAP XR | 183 | 2276 | 48 | 2276 | 88 | 88 | 421 | 1 | 37 | 38 | 257 |
| 173 | HE8MG65 | 209010 Apr. 28, 1997 209085 May 29, 1997 | Uni-ZAP XR | 243 | 2271 | 56 | 2232 | 79 | 79 | 481 | 1 | 43 | 44 | 170 |
| 174 | HE9FB42 | 20910 Apr. 28, 1997 209085 May 29, 1997 | Uni-ZAP XR | 184 | 3374 | 86 | 1705 | 277 | 277 | 422 | 1 | 40 | 41 | 704 |
| 174 | HE9FB42 | 209010 Apr. 28, 1997 209085 May 29, 1997 | Uni-ZAP XR | 244 | 2500 | 76 | 1693 | 518 | 518 | 482 | 1 | 1 | 2 | 623 |
| 175 | HEMAM41 | 209010 Apr. 28, 1997 209085 May 29, 1997 | Uni-ZAP XR | 185 | 1337 | 60 | 1328 | 175 | 175 | 423 | 1 | 39 | 40 | 190 |
| 175 | HEMAM41 | 209010 Apr. 28, 1997 209085 May 29, 1997 | Uni-ZAP XR | 245 | 1338 | 33 | 1327 | 175 | 175 | 483 | 1 | 32 | 33 | 91 |
| 176 | HEMCV19 | 209010 Apr. 28, 1997 209085 May 29, 1997 | Uni-ZAP XR | 186 | 941 | 33 | 931 | 79 | 79 | 424 | 1 | 23 | 24 | 178 |
| 177 | HEMDX17 | 209010 Apr. 28, 1997 209085 May 29, 1997 | Uni-ZAP XR | 187 | 678 | 1 | 678 | 131 | 131 | 425 | 1 | 21 | 22 | 40 |
| 177 | HEMDX17 | 209010 Apr. 28, 1997 209085 May 29, 1997 | Uni-ZAP XR | 246 | 654 | 1 | 654 | 137 | 137 | 484 | 1 | | | 12 |
| 178 | HETAR54 | 209010 Apr. 28, 1997 209085 May 29, 1997 | Uni-ZAP XR | 188 | 1848 | 454 | 1848 | 948 | 948 | 426 | 1 | 14 | 15 | 232 |
| 179 | HETBX14 | 209010 Apr. 28, 1997 209085 May 29, 1997 | Uni-ZAP XR | 189 | 1292 | 303 | 1292 | 207 | 207 | 427 | 1 | 18 | 19 | 250 |
| 179 | HETBX14 | 209010 Apr. 28, 1997 209085 May 29, 1997 | Uni-ZAP XR | 247 | 1146 | 157 | 1146 | | 74 | 485 | 1 | 14 | 15 | 53 |

-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of First AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 180 | HFGAB48 | 209010 Apr. 28, 1997 209085 May 29, 1997 | Uni-ZAP XR | 190 | 906 | 156 | 906 | 628 | 628 | 428 | 1 | 23 | 24 | 58 |
| 181 | HFKFI40 | 209010 Apr. 28, 1997 209085 May 29, 1997 | Uni-ZAP XR | 191 | 1941 | 120 | 1002 | 213 | 213 | 429 | 1 | 18 | 19 | 218 |
| 182 | HFXHN68 | 209010 Apr. 28, 1997 209085 May 29, 1997 | Lambda ZAP II | 192 | 2118 | 777 | 2118 | 966 | 966 | 430 | 1 | 23 | 24 | 50 |
| 183 | HGBFO79 | 209011 Apr. 28, 1997 | Uni-ZAP XR | 193 | 1538 | 259 | 1538 | 273 | 273 | 431 | 1 | 23 | 24 | 49 |
| 184 | HGLAM56 | 209011 Apr. 28, 1997 | Uni-ZAP XR | 194 | 1098 | 68 | 1098 | | 185 | 432 | 1 | 28 | 29 | 69 |
| 185 | HHLBA89 | 209011 Apr. 28, 1997 | pBluescript SK- | 195 | 1001 | 1 | 1001 | 324 | 324 | 433 | 1 | 25 | 26 | 39 |
| 186 | HHPDW05 | 209011 Apr. 28, 1997 | Uni-ZAP XR | 196 | 1458 | 1 | 1458 | 254 | 254 | 434 | 1 | 17 | 18 | 104 |
| 186 | HHPSD37 | 209011 Apr. 28, 1997 | Uni-ZAP XR | 248 | 1443 | 1 | 1443 | 246 | 246 | 486 | 1 | 21 | 22 | 21 |
| 187 | HHPSD37 | 209011 Apr. 28, 1997 | pBluescript | 197 | 1282 | 66 | 1282 | 171 | 171 | 435 | 1 | 19 | 20 | 37 |
| 188 | HHPSF70 | 209011 Apr. 28, 1997 | pBluescript | 198 | 951 | 26 | 951 | | 162 | 436 | 1 | 16 | 17 | 34 |
| 189 | HHSAK25 | 209011 Apr. 28, 1997 | Uni-ZAP XR | 199 | 1740 | 1390 | 1740 | 1534 | 1534 | 437 | 1 | 19 | 20 | 31 |
| 190 | HJASB53 | 209011 Apr. 28, 1997 | pBluescript | 200 | 1707 | 401 | 1195 | 652 | 652 | 438 | 1 | 26 | 27 | 126 |
| 191 | HJABZ65 | 209011 Apr. 28, 1997 | pBluescript SK- | 201 | 779 | 1 | 779 | 23 | 23 | 439 | 1 | 26 | 27 | 68 |
| 192 | HJPBB39 | 209011 Apr. 28, 1997 | Uni-ZAP XR | 202 | 1617 | 188 | 1605 | 182 | 182 | 440 | 1 | 28 | 29 | 91 |
| 193 | HLHSK94 | 209011 Apr. 28, 1997 | pBluescript | 203 | 1974 | 1 | 1794 | 112 | 112 | 441 | 1 | 26 | 27 | 379 |
| 194 | HLHTC70 | 209011 Apr. 28, 1997 | pBluescript | 204 | 1057 | 229 | 1057 | 365 | 365 | 442 | 1 | 23 | 24 | 22 |
| 195 | HLMTW92 | 209011 Apr. 28, 1997 | Lambda ZAP II | 205 | 721 | 1 | 721 | 244 | 244 | 443 | 1 | 25 | 26 | 46 |
| 196 | HLTCY93 | 209011 Apr. 28, 1997 | Uni-ZAP XR | 206 | 2465 | 988 | 2465 | 387 | 387 | 444 | 1 | 27 | 28 | 214 |
| 197 | HLTDB65 | 209011 Apr. 28, 1997 | Uni-ZAP XR | 207 | 1480 | 1 | 1480 | | 371 | 445 | 1 | 15 | 16 | 143 |
| 198 | HMSHM43 | 209011 Apr. 28, 1997 | Uni-ZAP XR | 208 | 872 | 1 | 872 | 35 | 35 | 446 | 1 | 18 | 19 | 36 |
| 199 | HMSHQ24 | 209011 Apr. 28, 1997 | Uni-ZAP XR | 209 | 1779 | 16 | 1779 | 148 | 148 | 447 | 1 | 24 | 25 | 36 |
| 200 | HNFAH08 | 209011 Apr. 28, 1997 | Uni-ZAP XR | 210 | 2110 | 592 | 2110 | 611 | 611 | 448 | 1 | 18 | 19 | 191 |
| 201 | HNGAO10 | 209011 Apr. 28, 1997 | Uni-ZAP XR | 211 | 938 | 1 | 938 | 107 | 107 | 449 | 1 | 27 | 28 | 30 |
| 202 | HNGBE45 | 209011 Apr. 28, 1997 | Uni-ZAP XR | 212 | 1551 | 1 | 1551 | 114 | 114 | 450 | 1 | 21 | 22 | 100 |
| 203 | HNHAZ16 | 209011 Apr. 28, 1997 | Uni-ZAP XR | 213 | 997 | 1 | 997 | 202 | 202 | 451 | 1 | 24 | 25 | 36 |
| 204 | HNHCM59 | 209011 Apr. 28, 1997 | Uni-ZAP XR | 214 | 1496 | 1 | 1132 | | 165 | 452 | 1 | 28 | 29 | 41 |
| 205 | HOSFM22 | 97977 Apr. 4, 1997 209082 May 29, 1997 | Uni-ZAP XR | 215 | 1308 | 501 | 1308 | 1081 | 1081 | 453 | 1 | 46 | 47 | 48 |
| 206 | HPHAC88 | 97977 Apr. 4, 1997 209082 May 29, 1997 | Uni-ZAP XR | 216 | 1705 | 384 | 1705 | 549 | 549 | 454 | 1 | 23 | 24 | 24 |
| 207 | HCDEO95 | 209007 Apr. 28, 1997 209083 May 29, 1997 | Uni-ZAP XR | 217 | 999 | 608 | 999 | 273 | 273 | 455 | 1 | 22 | 23 | 54 |

Table 1 summarizes the information corresponding to each "Gene No." described above. The nucleotide sequence identified as "NT SEQ ID NO:X" was assembled from partially homologous ("overlapping") sequences obtained from the "cDNA clone ID" identified in Table 1 and, in some cases, from additional related DNA clones. The overlapping sequences were assembled into a single contiguous sequence of high redundancy (usually three to five overlapping sequences at each nucleotide position), resulting in a final sequence identified as SEQ ID NO:X.

The cDNA Clone ID was deposited on the date and given the corresponding deposit number listed in "ATCC Deposit No:Z and Date." Some of the deposits contain multiple different clones corresponding to the same gene. "Vector" refers to the type of vector contained in the cDNA Clone ID.

"Total NT Seq." refers to the total number of nucleotides in the contig identified by "Gene No." The deposited clone may contain all or most of these sequences, reflected by the nucleotide position indicated as "5' NT of Clone Seq." and the "3' NT of Clone Seq." of SEQ ID NO:X. The nucleotide position of SEQ ID NO:X of the putative start codon (methionine) is identified as "5' NT of Start Codon." Similarly, the nucleotide position of SEQ ID NO:X of the predicted signal sequence is identified as "5' NT of First AA of Signal Pep."

The translated amino acid sequence, beginning with the methionine, is identified as "AA SEQ ID NO:Y," although other reading frames can also be easily translated using known molecular biology techniques. The polypeptides produced by these alternative open reading frames are specifically contemplated by the present invention.

The first and last amino acid position of SEQ ID NO:Y of the predicted signal peptide is identified as "First AA of Sig Pep" and "Last AA of Sig Pep." The predicted first amino acid position of SEQ ID NO:Y of the secreted portion is identified as "Predicted First AA of Secreted Portion." Finally, the amino acid position of SEQ ID NO:Y of the last amino acid in the open reading frame is identified as "Last AA of ORF."

SEQ ID NO:X and the translated SEQ ID NO:Y are sufficiently accurate and otherwise suitable for a variety of uses well known in the art and described further below. For instance, SEQ ID NO:X is useful for designing nucleic acid hybridization probes that will detect nucleic acid sequences contained in SEQ ID NO:X or the cDNA contained in the deposited clone. These probes will also hybridize to nucleic acid molecules in biological samples, thereby enabling a variety of forensic and diagnostic methods of the invention. Similarly, polypeptides identified from SEQ ID NO:Y may be used to generate antibodies which bind specifically to the secreted proteins encoded by the cDNA clones identified in Table 1.

Nevertheless, DNA sequences generated by sequencing reactions can contain sequencing errors. The errors exist as misidentified nucleotides, or as insertions or deletions of nucleotides in the generated DNA sequence. The erroneously inserted or deleted nucleotides cause frame shifts in the reading frames of the predicted amino acid sequence. In these cases, the predicted amino acid sequence diverges from the actual amino acid sequence, even though the generated DNA sequence may be greater than 99.9% identical to the actual DNA sequence (for example, one base insertion or deletion in an open reading frame of over 1000 bases).

Accordingly, for those applications requiring precision in the nucleotide sequence or the amino acid sequence, the present invention provides not only the generated nucleotide sequence identified as SEQ ID NO:X and the predicted translated amino acid sequence identified as SEQ ID NO:Y, but also a sample of plasmid DNA containing a human cDNA of the invention deposited with the ATCC, as set forth in Table 1. The nucleotide sequence of each deposited clone can readily be determined by sequencing the deposited clone in accordance with known methods. The predicted amino acid sequence can then be verified from such deposits. Moreover, the amino acid sequence of the protein encoded by a particular clone can also be directly determined by peptide sequencing or by expressing the protein in a suitable host cell containing the deposited human cDNA, collecting the protein, and determining its sequence.

The present invention also relates to the genes corresponding to SEQ ID NO:X, SEQ ID NO:Y, or the deposited clone. The corresponding gene can be isolated in accordance with known methods using the sequence information disclosed herein. Such methods include preparing probes or primers from the disclosed sequence and identifying or amplifying the corresponding gene from appropriate sources of genomic material.

Also provided in the present invention are species homologs. Species homologs may be isolated and identified by making suitable probes or primers from the sequences provided herein and screening a suitable nucleic acid source for the desired homologue.

The polypeptides of the invention can be prepared in any suitable manner. Such polypeptides include isolated naturally occurring polypeptides, recombinantly produced polypeptides, synthetically produced polypeptides, or polypeptides produced by a combination of these methods. Means for preparing such polypeptides are well understood in the art.

The polypeptides may be in the form of the secreted protein, including the mature form, or may be a part of a larger protein, such as a fusion protein (see below). It is often advantageous to include an additional amino acid sequence which contains secretory or leader sequences, prosequences, sequences which aid in purification, such as multiple histidine residues, or an additional sequence for stability during recombinant production.

The polypeptides of the present invention are preferably provided in an isolated form, and preferably are substantially purified. A recombinantly produced version of a polypeptide, including the secreted polypeptide, can be substantially purified by the one-step method described in Smith and Johnson, Gene 67:31–40 (1988). Polypeptides of the invention also can be purified from natural or recombinant sources using antibodies of the invention raised against the secreted protein in methods which are well known in the art.

Signal Sequences

Methods for predicting whether a protein has a signal sequence, as well as the cleavage point for that sequence, are available. For instance, the method of McGeoch, Virus Res. 3:271–286 (1985), uses the information from a short N-terminal charged region and a subsequent uncharged region of the complete (uncleaved) protein. The method of von Heinje, Nucleic Acids Res. 14:4683–4690 (1986) uses the information from the residues surrounding the cleavage site, typically residues −13 to +2, where +1 indicates the amino terminus of the secreted protein. The accuracy of predicting the cleavage points of known mammalian secretory proteins for each of these methods is in the range of 75–80%. (von Heinje, supra.) However, the two methods do not always produce the same predicted cleavage point(s) for a given protein.

In the present case, the deduced amino acid sequence of the secreted polypeptide was analyzed by a computer program called SignalP (Henrik Nielsen et al., Protein Engineering 10:1–6 (1997)), which predicts the cellular location of a protein based on the amino acid sequence. As part of this computational prediction of localization, the methods of McGeoch and von Heinje are incorporated. The analysis of the amino acid sequences of the secreted proteins described herein by this program provided the results shown in Table 1.

As one of ordinary skill would appreciate, however, cleavage sites sometimes vary from organism to organism and cannot be predicted with absolute certainty. Accordingly, the present invention provides secreted polypeptides having a sequence shown in SEQ ID NO:Y which have an N-terminus beginning within 5 residues (i.e., + or −5 residues) of the predicted cleavage point. Similarly, it is also recognized that in some cases, cleavage of the signal sequence from a secreted protein is not entirely uniform, resulting in more than one secreted species. These polypeptides, and the polynucleotides encoding such polypeptides, are contemplated by the present invention.

Moreover, the signal sequence identified by the above analysis may not necessarily predict the naturally occurring signal sequence. For example, the naturally occurring signal sequence may be further upstream from the predicted signal sequence. However, it is likely that the predicted signal sequence will be capable of directing the secreted protein to the ER. These polypeptides, and the polynucleotides encoding such polypeptides, are contemplated by the present invention.

Polynucleotide and Polypeptide Variants

"Variant" refers to a polynucleotide or polypeptide differing from the polynucleotide or polypeptide of the present invention, but retaining essential properties thereof. Generally, variants are overall closely similar, and, in many regions, identical to the polynucleotide or polypeptide of the present invention.

By a polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence encoding the polypeptide. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. The query sequence may be an entire sequence shown in table 1, the ORF (open reading frame), or any fragement specified as described herein.

As a practical matter, whether any particular nucleic acid molecule or polypeptide is at least 90%, 95%, 96%, 97%, 98% or 99% identical to a nucleotide sequence of the presence invention can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al. (Comp. App. Biosci. (1990) 6:237–245). In a sequence alignment the query and subject sequences are both DNA sequences. An RNA sequence can be compared by converting U's to T's. The result of said global sequence alignment is in percent identity. Preferred parameters used in a FASTDB alignment of DNA sequences to calculate percent identiy are: Matrix=Unitary, k-tuple=4, Mismatch Penalty=1, Joining Penalty=30, Randomization Group Length=0, Cutoff Score=1, Gap Penalty=5, Gap Size Penalty 0.05, Window Size=500 or the lenght of the subject nucleotide sequence, whichever is shorter.

If the subject sequence is shorter than the query sequence because of 5' or 3' deletions, not because of internal deletions, a manual correction must be made to the results. This is becuase the FASTDB program does not account for 5' and 3' truncations of the subject sequence when calculating percent identity. For subject sequences truncated at the 5' or 3' ends, relative to the the query sequence, the percent identity is corrected by calculating the number of bases of the query sequence that are 5' and 3' of the subject sequence, which are not matched/aligned, as a percent of the total bases of the query sequence. Whether a nucleotide is matched/aligned is determined by results of the FASTDB sequence alignment. This percentage is then subtracted from the percent identity, calculated by the above FASTDB program using the specified parameters, to arrive at a final percent identity score. This corrected score is what is used for the purposes of the present invention. Only bases outside the 5' and 3' bases of the subject sequence, as displayed by the FASTDB alignment, which are not matched/aligned with the query sequence, are calculated for the purposes of manually adjusting the percent identity score.

For example, a 90 base subject sequence is aligned to a 100 base query sequence to determine percent identity. The deletions occur at the 5' end of the subject sequence and therefore, the FASTDB alignment does not show a matched/ alignement of the first 10 bases at 5' end. The 10 unpaired bases represent 10% of the sequence (number of bases at the 5' and 3' ends not matched/total number of bases in the query sequence) so 10% is subtracted from the percent identity score calculated by the FASTDB program. If the remaining 90 bases were perfectly matched the final percent identity would be 90%. In another example, a 90 base subject sequence is compared with a 100 base query sequence. This time the deletions are internal deletions so that there are no bases on the 5' or 3' of the subject sequence which are not matched/aligned with the query. In this case the percent identity calculated by FASTDB is not manually corrected. Once again, only bases 5' and 3' of the subject sequence which are not matched/aligned with the query sequnce are manually corrected for. No other manual corrections are to made for the purposes of the present invention.

By a polypeptide having an amino acid sequence at least, for example, 95% "identical" to a query amino acid sequence of the present invention, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, (indels) or substituted with another amino acid. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

As a practical matter, whether any particular polypeptide is at least 90%, 95%, 96%, 97%, 98% or 99% identical to, for instance, the amino acid sequences shown in Table 1 or to the amino acid sequence encoded by deposited DNA clone can be determined conventionally using known computer programs. A preferred method for determing the best overall match between a query sequence (a sequence of the present invention) and a subject sequence, also referred to as a global sequence alignment, can be determined using the FASTDB computer program based on the algorithm of Brutlag et al. (Comp. App. Biosci. (1990) 6:237–245). In a sequence alignment the query and subject sequences are either both nucleotide sequences or both amino acid sequences. The result of said global sequence alignment is in percent identity. Preferred parameters used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter.

If the subject sequence is shorter than the query sequence due to N- or C-terminal deletions, not because of internal deletions, a manual correction must be made to the results. This is becuase the FASTDB program does not account for N- and C-terminal truncations of the subject sequence when calculating global percent identity. For subject sequences truncated at the N- and C-termini, relative to the the query sequence, the percent identity is corrected by calculating the number of residues of the query sequence that are N- and C-terminal of the subject sequence, which are not matched/aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence.

For example, a 90 amino acid residue subject sequence is aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequnce are manually corrected for. No other manual corrections are to made for the purposes of the present invention.

The variants may contain alterations in the coding regions, non-coding regions, or both. Especially preferred are polynucleotide variants containing alterations which produce silent substitutions, additions, or deletions, but do not alter the properties or activities of the encoded polypeptide. Nucleotide variants produced by silent substitutions due to the degeneracy of the genetic code are preferred. Moreover, variants in which 5–10, 1–5, or 1–2 amino acids are substituted, deleted, or added in any combination are also preferred. Polynucleotide variants can be produced for a variety of reasons, e.g., to optimize codon expression for a particular host (change codons in the human mRNA to those preferred by a bacterial host such as E. coli).

Naturally occurring variants are called "allelic variants," and refer to one of several alternate forms of a gene occupying a given locus on a chromosome of an organism. (Genes II, Lewin, B., ed., John Wiley & Sons, New York (1985).) These allelic variants can vary at either the polynucleotide and/or polypeptide level. Alternatively, non-naturally occurring variants may be produced by mutagenesis techniques or by direct synthesis.

Using known methods of protein engineering and recombinant DNA technology, variants may be generated to improve or alter the characteristics of the polypeptides of the present invention. For instance, one or more amino acids can be deleted from the N-terminus or C-terminus of the secreted protein without substantial loss of biological function. The authors of Ron et al., J. Biol. Chem. 268: 2984–2988 (1993), reported variant KGF proteins having heparin binding activity even after deleting 3, 8, or 27 amino-terminal amino acid residues. Similarly, Interferon gamma exhibited up to ten times higher activity after deleting 8–10 amino acid residues from the carboxy terminus of this protein. (Dobeli et al., J. Biotechnology 7:199–216 (1988).)

Moreover, ample evidence demonstrates that variants often retain a biological activity similar to that of the naturally occurring protein. For example, Gayle and coworkers (J. Biol. Chem 268:22105–22111 (1993)) conducted extensive mutational analysis of human cytokine IL-1a. They used random mutagenesis to generate over 3,500 individual IL-1a mutants that averaged 2.5 amino acid changes per variant over the entire length of the molecule. Multiple mutations were examined at every possible amino acid position. The investigators found that "[m]ost of the molecule could be altered with little effect on either [binding or biological activity]." (See, Abstract.) In fact, only 23 unique amino acid sequences, out of more than 3,500 nucleotide sequences examined, produced a protein that significantly differed in activity from wild-type.

Furthermore, even if deleting one or more amino acids from the N-terminus or C-terminus of a polypeptide results in modification or loss of one or more biological functions, other biological activities may still be retained. For example, the ability of a deletion variant to induce and/or to bind antibodies which recognize the secreted form will likely be retained when less than the majority of the residues of the secreted form are removed from the N-terminus or C-terminus. Whether a particular polypeptide lacking N- or C-terminal residues of a protein retains such immunogenic activities can readily be determined by routine methods described herein and otherwise known in the art.

Thus, the invention further includes polypeptide variants which show substantial biological activity. Such variants include deletions, insertions, inversions, repeats, and substitutions selected according to general rules known in the art so as have little effect on activity. For example, guidance concerning how to make phenotypically silent amino acid substitutions is provided in Bowie, J. U. et al., Science 247:1306–1310 (1990), wherein the authors indicate that there are two main strategies for studying the tolerance of an amino acid sequence to change.

The first strategy exploits the tolerance of amino acid substitutions by natural selection during the process of evolution. By comparing amino acid sequences in different species, conserved amino acids can be identified. These conserved amino acids are likely important for protein function. In contrast, the amino acid positions where substitutions have been tolerated by natural selection indicates that these positions are not critical for protein function. Thus, positions tolerating amino acid substitution could be modified while still maintaining biological activity of the protein.

The second strategy uses genetic engineering to introduce amino acid changes at specific positions of a cloned gene to identify regions critical for protein function. For example, site directed mutagenesis or alanine-scanning mutagenesis (introduction of single alanine mutations at every residue in the molecule) can be used. (Cunningham and Wells, Science 244:1081–1085 (1989).) The resulting mutant molecules can then be tested for biological activity.

As the authors state, these two strategies have revealed that proteins are surprisingly tolerant of amino acid substitutions. The authors further indicate which amino acid changes are likely to be permissive at certain amino acid positions in the protein. For example, most buried (within the tertiary structure of the protein) amino acid residues require nonpolar side chains, whereas few features of surface side chains are generally conserved. Moreover, tolerated conservative amino acid substitutions involve replacement of the aliphatic or hydrophobic amino acids Ala, Val, Leu and Ile; replacement of the hydroxyl residues Ser and Thr; replacement of the acidic residues Asp and Glu; replacement of the amide residues Asn and Gln, replacement of the basic residues Lys, Arg, and His; replacement of the aromatic residues Phe, Tyr, and Trp, and replacement of the small-sized amino acids Ala, Ser, Thr, Met, and Gly.

Besides conservative amino acid substitution, variants of the present invention include (i) substitutions with one or more of the non-conserved amino acid residues, where the substituted amino acid residues may or may not be one encoded by the genetic code, or (ii) substitution with one or more of amino acid residues having a substituent group, or (iii) fusion of the mature polypeptide with another compound, such as a compound to increase the stability and/or solubility of the polypeptide (for example, polyethylene glycol), or (iv) fusion of the polypeptide with additional amino acids, such as an IgG Fc fusion region peptide, or leader or secretory sequence, or a sequence facilitating purification. Such variant polypeptides are deemed to be within the scope of those skilled in the art from the teachings herein.

For example, polypeptide variants containing amino acid substitutions of charged amino acids with other charged or neutral amino acids may produce proteins with improved characteristics, such as less aggregation. Aggregation of pharmaceutical formulations both reduces activity and increases clearance due to the aggregate's immunogenic activity. (Pinckard et al., Clin. Exp. Immunol. 2:331–340 (1967); Robbins et al., Diabetes 36: 838–845 (1987); Cleland et al., Crit. Rev. Therapeutic Drug Carrier Systems 10:307–377 (1993).)

Polynucleotide and Polypeptide Fragments

In the present invention, a "polynucleotide fragment" refers to a short polynucleotide having a nucleic acid sequence contained in the deposited clone or shown in SEQ ID NO:X. The short nucleotide fragments are preferably at least about 15 nt, and more preferably at least about 20 nt, still more preferably at least about 30 nt, and even more preferably, at least about 40 nt in length. A fragment "at least 20 nt in length," for example, is intended to include 20 or more contiguous bases from the cDNA sequence contained in the deposited clone or the nucleotide sequence shown in SEQ ID NO:X. These nucleotide fragments are useful as diagnostic probes and primers as discussed herein. Of course, larger fragments (e.g., 50, 150, 500, 600, 2000 nucleotides) are preferred.

Moreover, representative examples of polynucleotide fragments of the invention, include, for example, fragments having a sequence from about nucleotide number 1–50, 51–100, 101–150, 151–200, 201–250, 251–300, 301–350, 351–400, 401–450, 451–500, 501–550, 551–600, 651–700, 701–750, 751–800, 800–850, 851–900, 901–950, 951–1000, 1001–1050, 1051–1100, 1101–1150, 1151–1200, 1201–1250, 1251–1300, 1301–1350, 1351–1400, 1401–1450, 1451–1500, 1501–1550, 1551–1600, 1601–1650, 1651–1700, 1701–1750, 1751–1800, 1801–1850, 1851–1900, 1901–1950, 1951–2000, or 2001 to the end of SEQ ID NO:X or the cDNA contained in the deposited clone. In this context "about" includes the particularly recited ranges, larger or smaller by several (5, 4, 3, 2, or 1) nucleotides, at either terminus or at both termini. Preferably, these fragments encode a polypeptide which has biological activity. More preferably, these polynucleotides can be used as probes or primers as discussed herein.

In the present invention, a "polypeptide fragment" refers to a short amino acid sequence contained in SEQ ID NO:Y or encoded by the cDNA contained in the deposited clone. Protein fragments may be "free-standing," or comprised within a larger polypeptide of which the fragment forms a part or region, most preferably as a single continuous region. Representative examples of polypeptide fragments of the invention, include, for example, fragments from about amino acid number 1–20, 21–40, 41–60, 61–80, 81–100, 102–120, 121–140, 141–160, or 161 to the end of the coding region. Moreover, polypeptide fragments can be about 20, 30, 40, 50, 60, 70, 80, 90, 100, 110, 120, 130, 140, or 150 amino acids in length. In this context "about" includes the particularly recited ranges, larger or smaller by several (5, 4, 3, 2, or 1) amino acids, at either extreme or at both extremes.

Preferred polypeptide fragments include the secreted protein as well as the mature form. Further preferred polypeptide fragments include the secreted protein or the mature form having a continuous series of deleted residues from the amino or the carboxy terminus, or both. For example, any number of amino acids, ranging from 1–60, can be deleted from the amino terminus of either the secreted polypeptide or the mature form. Similarly, any number of amino acids, ranging from 1–30, can be deleted from the carboxy terminus of the secreted protein or mature form. Furthermore, any combination of the above amino and carboxy terminus deletions are preferred. Similarly, polynucleotide fragments encoding these polypeptide fragments are also preferred.

Also preferred are polypeptide and polynucleotide fragments characterized by structural or functional domains, such as fragments that comprise alpha-helix and alpha-helix forming regions, beta-sheet and beta-sheet-forming regions, turn and turn-forming regions, coil and coil-forming regions, hydrophilic regions, hydrophobic regions, alpha amphipathic regions, beta amphipathic regions, flexible regions, surface-forming regions, substrate binding region, and high antigenic index regions. Polypeptide fragments of SEQ ID NO:Y falling within conserved domains are specifically contemplated by the present invention. Moreover, polynucleotide fragments encoding these domains are also contemplated.

Other preferred fragments are biologically active fragments. Biologically active fragments are those exhibiting activity similar, but not necessarily identical, to an activity of the polypeptide of the present invention. The biological activity of the fragments may include an improved desired activity, or a decreased undesirable activity.

Epitopes & Antibodies

In the present invention, "epitopes" refer to polypeptide fragments having antigenic or immunogenic activity in an animal, especially in a human. A preferred embodiment of the present invention relates to a polypeptide fragment comprising an epitope, as well as the polynucleotide encoding this fragment. A region of a protein molecule to which an antibody can bind is defined as an "antigenic epitope." In contrast, an "immunogenic epitope" is defined as a part of a protein that elicits an antibody response. (See, for instance, Geysen et al., Proc. Natl. Acad. Sci. USA 81:3998–4002 (1983).)

Fragments which function as epitopes may be produced by any conventional means. (See, e.g., Houghten, R. A., Proc. Natl. Acad. Sci. USA 82:5131–5135 (1985) further described in U.S. Pat. No. 4,631,211.)

In the present invention, antigenic epitopes preferably contain a sequence of at least seven, more preferably at least nine, and most preferably between about 15 to about 30 amino acids. Antigenic epitopes are useful to raise antibodies, including monoclonal antibodies, that specifically bind the epitope. (See, for instance, Wilson et al., Cell 37:767–778 (1984); Sutcliffe, J. G. et al., Science 219:660–666 (1983).)

Similarly, immunogenic epitopes can be used to induce antibodies according to methods well known in the art. (See, for instance, Sutcliffe et al., supra; Wilson et al., supra; Chow, M. et al., Proc. Natl. Acad. Sci. USA 82:910–914; and Bittle, F. J. et al., J. Gen. Virol. 66:2347–2354 (1985).) A preferred immunogenic epitope includes the secreted protein. The immunogenic epitopes may be presented together with a carrier protein, such as an albumin, to an animal system (such as rabbit or mouse) or, if it is long enough (at least about 25 amino acids), without a carrier. However, immunogenic epitopes comprising as few as 8 to 10 amino acids have been shown to be sufficient to raise antibodies capable of binding to, at the very least, linear epitopes in a denatured polypeptide (e.g., in Western blotting.)

As used herein, the term "antibody" (Ab) or "monoclonal antibody" (Mab) is meant to include intact molecules as well as antibody fragments (such as, for example, Fab and F(ab')2 fragments) which are capable of specifically binding to protein. Fab and F(ab')2 fragments lack the Fc fragment of intact antibody, clear more rapidly from the circulation, and may have less non-specific tissue binding than an intact antibody. (Wahl et al., J. Nucl. Med. 24:316–325 (1983).) Thus, these fragments are preferred, as well as the products of a FAB or other immunoglobulin expression library. Moreover, antibodies of the present invention include chimeric, single chain, and humanized antibodies.

Fusion Proteins

Any polypeptide of the present invention can be used to generate fusion proteins. For example, the polypeptide of the present invention, when fused to a second protein, can be used as an antigenic tag. Antibodies raised against the polypeptide of the present invention can be used to indirectly detect the second protein by binding to the polypeptide. Moreover, because secreted proteins target cellular locations based on trafficking signals, the polypeptides of the present invention can be used as targeting molecules once fused to other proteins.

Examples of domains that can be fused to polypeptides of the present invention include not only heterologous signal sequences, but also other heterologous functional regions. The fusion does not necessarily need to be direct, but may occur through linker sequences.

Moreover, fusion proteins may also be engineered to improve characteristics of the polypeptide of the present invention. For instance, a region of additional amino acids, particularly charged amino acids, may be added to the N-terminus of the polypeptide to improve stability and persistence during purification from the host cell or subsequent handling and storage. Also, peptide moieties may be added to the polypeptide to facilitate purification. Such regions may be removed prior to final preparation of the polypeptide. The addition of peptide moieties to facilitate handling of polypeptides are familiar and routine techniques in the art.

Moreover, polypeptides of the present invention, including fragments, and specifically epitopes, can be combined with parts of the constant domain of immunoglobulins (IgG), resulting in chimeric polypeptides. These fusion proteins facilitate purification and show an increased half-life in vivo. One reported example describes chimeric proteins consisting of the first two domains of the human CD4-polypeptide and various domains of the constant regions of the heavy or light chains of mammalian immunoglobulins. (EP A 394,827; Traunecker et al., Nature 331:84–86 (1988).) Fusion proteins having disulfide-linked dimeric structures (due to the IgG) can also be more efficient in binding and neutralizing other molecules, than the monomeric secreted protein or protein fragment alone. (Fountoulakis et al., J. Biochem. 270:3958–3964 (1995).)

Similarly, EP-A-O 464 533 (Canadian counterpart 2045869) discloses fusion proteins comprising various portions of constant region of immunoglobulin molecules together with another human protein or part thereof. In many cases, the Fc part in a fusion protein is beneficial in therapy and diagnosis, and thus can result in, for example, improved pharmacokinetic properties. (EP-A 0232 262.) Alternatively, deleting the Fc part after the fusion protein has been expressed, detected, and purified, would be desired. For example, the Fc portion may hinder therapy and diagnosis if the fusion protein is used as an antigen for immunizations. In drug discovery, for example, human proteins, such as hIL-5, have been fused with Fc portions for the purpose of high-throughput screening assays to identify antagonists of hIL-5. (See, D. Bennett et al., J. Molecular Recognition 8:52–58 (1995); K. Johanson et al., J. Biol. Chem. 270:9459–9471 (1995).)

Moreover, the polypeptides of the present invention can be fused to marker sequences, such as a peptide which facilitates purification of the fused polypeptide. In preferred embodiments, the marker amino acid sequence is a hexa-histidine peptide, such as the tag provided in a pQE vector (QIAGEN, Inc., 9259 Eton Avenue, Chatsworth, Calif., 91311), among others, many of which are commercially available. As described in Gentz et al., Proc. Natl. Acad. Sci. USA 86:821–824 (1989), for instance, hexa-histidine provides for convenient purification of the fusion protein. Another peptide tag useful for purification, the "HA" tag, corresponds to an epitope derived from the influenza hemagglutinin protein. (Wilson et al., Cell 37:767 (1984).)

Thus, any of these above fusions can be engineered using the polynucleotides or the polypeptides of the present invention.

Vectors, Host Cells, and Protein Production

The present invention also relates to vectors containing the polynucleotide of the present invention, host cells, and the production of polypeptides by recombinant techniques. The vector may be, for example, a phage, plasmid, viral, or retroviral vector. Retroviral vectors may be replication competent or replication defective. In the latter case, viral propagation generally will occur only in complementing host cells.

The polynucleotides may be joined to a vector containing a selectable marker for propagation in a host. Generally, a plasmid vector is introduced in a precipitate, such as a calcium phosphate precipitate, or in a complex with a charged lipid. If the vector is a virus, it may be packaged in vitro using an appropriate packaging cell line and then transduced into host cells.

The polynucleotide insert should be operatively linked to an appropriate promoter, such as the phage lambda PL promoter, the E. coli lac, trp, phoA and tac promoters, the SV40 early and late promoters and promoters of retroviral LTRs, to name a few. Other suitable promoters will be known to the skilled artisan. The expression constructs will further contain sites for transcription initiation, termination, and, in the transcribed region, a ribosome binding site for translation. The coding portion of the transcripts expressed by the constructs will preferably include a translation initiating codon at the beginning and a termination codon (UAA, UGA or UAG) appropriately positioned at the end of the polypeptide to be translated.

As indicated, the expression vectors will preferably include at least one selectable marker. Such markers include dihydrofolate reductase, G418 or neomycin resistance for eukaryotic cell culture and tetracycline, kanamycin or ampicillin resistance genes for culturing in E. coli and other bacteria. Representative examples of appropriate hosts include, but are not limited to, bacterial cells, such as E. coli, Streptomyces and Salmonella typhimurium cells; fungal cells, such as yeast cells; insect cells such as Drosophila S2 and Spodoptera Sf9 cells; animal cells such as CHO, COS, 293, and Bowes melanoma cells; and plant cells. Appropriate culture mediums and conditions for the above-described host cells are known in the art.

Among vectors preferred for use in bacteria include pQE70, pQE60 and pQE-9, available from QIAGEN, Inc.; pBluescript vectors, Phagescript vectors, pNH8A, pNH16a, pNH18A, pNH46A, available from Stratagene Cloning Systems, Inc.; and ptrc99a, pKK223-3, pKK233-3, pDR540, pRIT5 available from Pharmacia Biotech, Inc. Among preferred eukaryotic vectors are pWLNEO, pSV2CAT, pOG44, pXT1 and pSG available from Stratagene; and pSVK3, pBPV, pMSG and pSVL available from Pharmacia. Other suitable vectors will be readily apparent to the skilled artisan.

Introduction of the construct into the host cell can be effected by calcium phosphate transfection, DEAE-dextran mediated transfection, cationic lipid-mediated transfection, electroporation, transduction, infection, or other methods. Such methods are described in many standard laboratory manuals, such as Davis et al., Basic Methods In Molecular Biology (1986). It is specifically contemplated that the polypeptides of the present invention may in fact be expressed by a host cell lacking a recombinant vector.

A polypeptide of this invention can be recovered and purified from recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Most preferably, high performance liquid chromatography ("HPLC") is employed for purification.

Polypeptides of the present invention, and preferably the secreted form, can also be recovered from: products purified from natural sources, including bodily fluids, tissues and cells, whether directly isolated or cultured; products of chemical synthetic procedures; and products produced by recombinant techniques from a prokaryotic or eukaryotic host, including, for example, bacterial, yeast, higher plant, insect, and mammalian cells. Depending upon the host employed in a recombinant production procedure, the polypeptides of the present invention may be glycosylated or may be non-glycosylated. In addition, polypeptides of the invention may also include an initial modified methionine residue, in some cases as a result of host-mediated processes. Thus, it is well known in the art that the N-terminal methionine encoded by the translation initiation codon generally is removed with high efficiency from any protein after translation in all eukaryotic cells. While the N-terminal methionine on most proteins also is efficiently removed in most prokaryotes, for some proteins, this prokaryotic removal process is inefficient, depending on the nature of the amino acid to which the N-terminal methionine is covalently linked.

Uses of the Polynucleotides

Each of the polynucleotides identified herein can be used in numerous ways as reagents. The following description should be considered exemplary and utilizes known techniques.

The polynucleotides of the present invention are useful for chromosome identification. There exists an ongoing need to identify new chromosome markers, since few chromosome marking reagents, based on actual sequence data (repeat polymorphisms), are presently available. Each polynucleotide of the present invention can be used as a chromosome marker.

Briefly, sequences can be mapped to chromosomes by preparing PCR primers (preferably 15–25 bp) from the sequences shown in SEQ ID NO:X. Primers can be selected using computer analysis so that primers do not span more than one predicted exon in the genomic DNA. These primers are then used for PCR screening of somatic cell hybrids containing individual human chromosomes. Only those hybrids containing the human gene corresponding to the SEQ ID NO:X will yield an amplified fragment.

Similarly, somatic hybrids provide a rapid method of PCR mapping the polynucleotides to particular chromosomes. Three or more clones can be assigned per day using a single thermal cycler. Moreover, sublocalization of the polynucleotides can be achieved with panels of specific chromosome fragments. Other gene mapping strategies that can be used include in situ hybridization, prescreening with labeled flow-sorted chromosomes, and preselection by hybridization to construct chromosome specific-cDNA libraries.

Precise chromosomal location of the polynucleotides can also be achieved using fluorescence in situ hybridization (FISH) of a metaphase chromosomal spread. This technique uses polynucleotides as short as 500 or 600 bases; however, polynucleotides 2,000–4,000 bp are preferred. For a review of this technique, see Verma et al., "Human Chromosomes: a Manual of Basic Techniques," Pergamon Press, New York (1988).

For chromosome mapping, the polynucleotides can be used individually (to mark a single chromosome or a single site on that chromosome) or in panels (for marking multiple sites and/or multiple chromosomes). Preferred polynucleotides correspond to the noncoding regions of the cDNAs because the coding sequences are more likely conserved within gene families, thus increasing the chance of cross hybridization during chromosomal mapping.

Once a polynucleotide has been mapped to a precise chromosomal location, the physical position of the polynucleotide can be used in linkage analysis. Linkage analysis establishes coinheritance between a chromosomal location and presentation of a particular disease. (Disease mapping data are found, for example, in V. McKusick, Mendelian Inheritance in Man (available on line through Johns Hopkins University Welch Medical Library).) Assuming 1 megabase mapping resolution and one gene per 20 kb, a cDNA precisely localized to a chromosomal region associated with the disease could be one of 50–500 potential causative genes.

Thus, once coinheritance is established, differences in the polynucleotide and the corresponding gene between affected and unaffected individuals can be examined. First, visible structural alterations in the chromosomes, such as deletions or translocations, are examined in chromosome spreads or by PCR. If no structural alterations exist, the presence of point mutations are ascertained. Mutations observed in some or all affected individuals, but not in normal individuals, indicates that the mutation may cause the disease. However, complete sequencing of the polypeptide and the corresponding gene from several normal individuals is required to distinguish the mutation from a polymorphism. If a new polymorphism is identified, this polymorphic polypeptide can be used for further linkage analysis.

Furthermore, increased or decreased expression of the gene in affected individuals as compared to unaffected individuals can be assessed using polynucleotides of the present invention. Any of these alterations (altered expression, chromosomal rearrangement, or mutation) can be used as a diagnostic or prognostic marker.

In addition to the foregoing, a polynucleotide can be used to control gene expression through triple helix formation or antisense DNA or RNA. Both methods rely on binding of the polynucleotide to DNA or RNA. For these techniques, preferred polynucleotides are usually 20 to 40 bases in length and complementary to either the region of the gene involved in transcription (triple helix—see Lee et al., Nucl. Acids Res. 6:3073 (1979); Cooney et al., Science 241:456 (1988); and Dervan et al., Science 251:1360 (1991) ) or to the mRNA itself (antisense—Okano, J. Neurochem. 56:560 (1991); Oligodeoxy-nucleotides as Antisense Inhibitors of Gene Expression, CRC Press, Boca Raton, Fla. (1988).) Triple helix formation optimally results in a shut-off of RNA transcription from DNA, while antisense RNA hybridization blocks translation of an mRNA molecule into polypeptide. Both techniques are effective in model systems, and the information disclosed herein can be used to design antisense or triple helix polynucleotides in an effort to treat disease.

Polynucleotides of the present invention are also useful in gene therapy. One goal of gene therapy is to insert a normal gene into an organism having a defective gene, in an effort to correct the genetic defect. The polynucleotides disclosed in the present invention offer a means of targeting such genetic defects in a highly accurate manner. Another goal is to insert a new gene that was not present in the host genome, thereby producing a new trait in the host cell.

The polynucleotides are also useful for identifying individuals from minute biological samples. The United States military, for example, is considering the use of restriction fragment length polymorphism (RFLP) for identification of its personnel. In this technique, an individual's genomic DNA is digested with one or more restriction enzymes, and probed on a Southern blot to yield unique bands for identifying personnel. This method does not suffer from the current limitations of "Dog Tags" which can be lost, switched, or stolen, making positive identification difficult. The polynucleotides of the present invention can be used as additional DNA markers for RFLP.

The polynucleotides of the present invention can also be used as an alternative to RFLP, by determining the actual base-by-base DNA sequence of selected portions of an individual's genome. These sequences can be used to prepare PCR primers for amplifying and isolating such selected DNA, which can then be sequenced. Using this technique, individuals can be identified because each individual will have a unique set of DNA sequences. Once an unique ID database is established for an individual, positive identification of that individual, living or dead, can be made from extremely small tissue samples.

Forensic biology also benefits from using DNA-based identification techniques as disclosed herein. DNA sequences taken from very small biological samples such as tissues, e.g., hair or skin, or body fluids, e.g., blood, saliva, semen, etc., can be amplified using PCR. In one prior art technique, gene sequences amplified from polymorphic loci, such as DQa class II HLA gene, are used in forensic biology to identify individuals. (Erlich, H., PCR Technology, Freeman and Co. (1992).) Once these specific polymorphic loci are amplified, they are digested with one or more restriction enzymes, yielding an identifying set of bands on a Southern blot probed with DNA corresponding to the DQa class II HLA gene. Similarly, polynucleotides of the present invention can be used as polymorphic markers for forensic purposes.

There is also a need for reagents capable of identifying the source of a particular tissue. Such need arises, for example, in forensics when presented with tissue of unknown origin. Appropriate reagents can comprise, for example, DNA probes or primers specific to particular tissue prepared from the sequences of the present invention. Panels of such reagents can identify tissue by species and/or by organ type. In a similar fashion, these reagents can be used to screen tissue cultures for contamination.

In the very least, the polynucleotides of the present invention can be used as molecular weight markers on Southern gels, as diagnostic probes for the presence of a specific mRNA in a particular cell type, as a probe to "subtract-out" known sequences in the process of discovering novel polynucleotides, for selecting and making oligomers for attachment to a "gene chip" or other support, to raise anti-DNA antibodies using DNA immunization techniques, and as an antigen to elicit an immune response.

Uses of the Polypeptides

Each of the polypeptides identified herein can be used in numerous ways. The following description should be considered exemplary and utilizes known techniques.

A polypeptide of the present invention can be used to assay protein levels in a biological sample using antibody-based techniques. For example, protein expression in tissues can be studied with classical immunohistological methods. (Jalkanen, M., et al., J. Cell. Biol. 101:976–985 (1985); Jalkanen, M., et al., J. Cell . Biol. 105:3087–3096 (1987).) Other antibody-based methods useful for detecting protein gene expression include immunoassays, such as the enzyme linked immunosorbent assay (ELISA) and the radioimmunoassay (RIA). Suitable antibody assay labels are known in the art and include enzyme labels, such as, glucose oxidase, and radioisotopes, such as iodine (125I, 121I), carbon (14C), sulfur (35S), tritium (3H), indium (112In), and technetium (99mTc), and fluorescent labels, such as fluorescein and rhodamine, and biotin.

In addition to assaying secreted protein levels in a biological sample, proteins can also be detected in vivo by imaging. Antibody labels or markers for in vivo imaging of protein include those detectable by X-radiography, NMR or ESR. For X-radiography, suitable labels include radioisotopes such as barium or cesium, which emit detectable radiation but are not overtly harmful to the subject. Suitable markers for NMR and ESR include those with a detectable characteristic spin, such as deuterium, which may be incorporated into the antibody by labeling of nutrients for the relevant hybridoma.

A protein-specific antibody or antibody fragment which has been labeled with an appropriate detectable imaging moiety, such as a radioisotope (for example, 131I, 112In, 99mTc), a radio-opaque substance, or a material detectable by nuclear magnetic resonance, is introduced (for example, parenterally, subcutaneously, or intraperitoneally) into the mammal. It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of 99mTc. The labeled antibody or antibody fragment will then preferentially accumulate at the location of cells which contain the specific protein. In vivo tumor imaging is described in S. W. Burchiel et al., "Immunopharmacokinetics of Radiolabeled Antibodies and Their Fragments." (Chapter 13 in Tumor Imaging: The Radiochemical Detection of Cancer, S. W. Burchiel and B. A. Rhodes, eds., Masson Publishing Inc. (1982).)

Thus, the invention provides a diagnostic method of a disorder, which involves (a) assaying the expression of a polypeptide of the present invention in cells or body fluid of an individual; (b) comparing the level of gene expression with a standard gene expression level, whereby an increase or decrease in the assayed polypeptide gene expression level compared to the standard expression level is indicative of a disorder.

Moreover, polypeptides of the present invention can be used to treat disease. For example, patients can be administered a polypeptide of the present invention in an effort to replace absent or decreased levels of the polypeptide (e.g., insulin), to supplement absent or decreased levels of a different polypeptide (e.g., hemoglobin S for hemoglobin B), to inhibit the activity of a polypeptide (e.g., an oncogene), to activate the activity of a polypeptide (e.g., by binding to a receptor), to reduce the activity of a membrane bound receptor by competing with it for free ligand (e.g., soluble TNF receptors used in reducing inflammation), or to bring about a desired response (e.g., blood vessel growth).

Similarly, antibodies directed to a polypeptide of the present invention can also be used to treat disease. For example, administration of an antibody directed to a polypeptide of the present invention can bind and reduce overproduction of the polypeptide. Similarly, administration of an antibody can activate the polypeptide, such as by binding to a polypeptide bound to a membrane (receptor).

At the very least, the polypeptides of the present invention can be used as molecular weight markers on SDS-PAGE gels or on molecular sieve gel filtration columns using methods well known to those of skill in the art. Polypeptides can also be used to raise antibodies, which in turn are used to measure protein expression from a recombinant cell, as a way of assessing transformation of the host cell. Moreover, the polypeptides of the present invention can be used to test the following biological activities.

Biological Activities

The polynucleotides and polypeptides of the present invention can be used in assays to test for one or more biological activities. If these polynucleotides and polypeptides do exhibit activity in a particular assay, it is likely that these molecules may be involved in the diseases associated with the biological activity. Thus, the polynucleotides and polypeptides could be used to treat the associated disease.

Immune Activity

A polypeptide or polynucleotide of the present invention may be useful in treating deficiencies or disorders of the immune system, by activating or inhibiting the proliferation, differentiation, or mobilization (chemotaxis) of immune cells. Immune cells develop through a process called hematopoiesis, producing myeloid (platelets, red blood cells, neutrophils, and macrophages) and lymphoid (B and T lymphocytes) cells from pluripotent stem cells. The etiology of these immune deficiencies or disorders may be genetic, somatic, such as cancer or some autoimmune disorders, acquired (e.g., by chemotherapy or toxins), or infectious. Moreover, a polynucleotide or polypeptide of the present invention can be used as a marker or detector of a particular immune system disease or disorder.

A polynucleotide or polypeptide of the present invention may be useful in treating or detecting deficiencies or disorders of hematopoietic cells. A polypeptide or polynucleotide of the present invention could be used to increase differentiation and proliferation of hematopoietic cells, including the pluripotent stem cells, in an effort to treat those disorders associated with a decrease in certain (or many) types hematopoietic cells. Examples of immunologic deficiency syndromes include, but are not limited to: blood protein disorders (e.g. agammaglobulinemia, dysgammaglobulinemia), ataxia telangiectasia, common variable immunodeficiency, Digeorge Syndrome, HIV infection, HTLV-BLV infection, leukocyte adhesion deficiency syndrome, lymphopenia, phagocyte bactericidal dysfunction, severe combined immunodeficiency (SCIDs), Wiskott-Aldrich Disorder, anemia, thrombocytopenia, or hemoglobinuria.

Moreover, a polypeptide or polynucleotide of the present invention could also be used to modulate hemostatic (the stopping of bleeding) or thrombolytic activity (clot formation). For example, by increasing hemostatic or thrombolytic activity, a polynucleotide or polypeptide of the present invention could be used to treat blood coagulation disorders (e.g., afibrinogenemia, factor deficiencies), blood platelet disorders (e.g. thrombocytopenia), or wounds resulting from trauma, surgery, or other causes. Alternatively, a polynucleotide or polypeptide of the present invention that can decrease hemostatic or thrombolytic activity could be used to inhibit or dissolve clotting. These molecules could be important in the treatment of heart attacks (infarction), strokes, or scarring.

A polynucleotide or polypeptide of the present invention may also be useful in treating or detecting autoimmune disorders. Many autoimmune disorders result from inappropriate recognition of self as foreign material by immune cells. This inappropriate recognition results in an immune response leading to the destruction of the host tissue. Therefore, the administration of a polypeptide or polynucleotide of the present invention that inhibits an immune response, particularly the proliferation, differentiation, or chemotaxis of T-cells, may be an effective therapy in preventing autoimmune disorders.

Examples of autoimmune disorders that can be treated or detected by the present invention include, but are not limited to: Addison's Disease, hemolytic anemia, antiphospholipid syndrome, rheumatoid arthritis, dermatitis, allergic encephalomyelitis, glomerulonephritis, Goodpasture's Syndrome, Graves' Disease, Multiple Sclerosis, Myasthenia Gravis, Neuritis, Ophthalmia, Bullous Pemphigoid, Pemphigus, Polyendocrinopathies, Purpura, Reiter's Disease, Stiff-Man Syndrome, Autoimmune Thyroiditis, Systemic Lupus Erythematosus, Autoimmune Pulmonary Inflammation, Guillain-Barre Syndrome, insulin dependent diabetes mellitis, and autoimmune inflammatory eye disease.

Similarly, allergic reactions and conditions, such as asthma (particularly allergic asthma) or other respiratory problems, may also be treated by a polypeptide or polynucleotide of the present invention. Moreover, these molecules can be used to treat anaphylaxis, hypersensitivity to an antigenic molecule, or blood group incompatibility.

A polynucleotide or polypeptide of the present invention may also be used to treat and/or prevent organ rejection or graft-versus-host disease (GVHD). Organ rejection occurs by host immune cell destruction of the transplanted tissue through an immune response. Similarly, an immune response is also involved in GVHD, but, in this case, the foreign transplanted immune cells destroy the host tissues. The administration of a polypeptide or polynucleotide of the present invention that inhibits an immune response, particularly the proliferation, differentiation, or chemotaxis of T-cells, may be an effective therapy in preventing organ rejection or GVHD.

Similarly, a polypeptide or polynucleotide of the present invention may also be used to modulate inflammation. For example, the polypeptide or polynucleotide may inhibit the proliferation and differentiation of cells involved in an inflammatory response. These molecules can be used to treat inflammatory conditions, both chronic and acute conditions, including inflammation associated with infection (e.g., septic shock, sepsis, or systemic inflammatory response syndrome (SIRS)), ischemia-reperfusion injury, endotoxin lethality, arthritis, complement-mediated hyperacute rejection, nephritis, cytokine or chemokine induced lung injury, inflammatory bowel disease, Crohn's disease, or resulting from over production of cytokines (e.g., TNF or IL-1.)

Hyperproliferative Disorders

A polypeptide or polynucleotide can be used to treat or detect hyperproliferative disorders, including neoplasms. A polypeptide or polynucleotide of the present invention may inhibit the proliferation of the disorder through direct or indirect interactions. Alternatively, a polypeptide or polynucleotide of the present invention may proliferate other cells which can inhibit the hyperproliferative disorder.

For example, by increasing an immune response, particularly increasing antigenic qualities of the hyperproliferative disorder or by proliferating, differentiating, or mobilizing T-cells, hyperproliferative disorders can be treated. This immune response may be increased by either enhancing an existing immune response, or by initiating a new immune response. Alternatively, decreasing an immune response may also be a method of treating hyperproliferative disorders, such as a chemotherapeutic agent.

Examples of hyperproliferative disorders that can be treated or detected by a polynucleotide or polypeptide of the present invention include, but are not limited to neoplasms located in the: abdomen, bone, breast, digestive system, liver, pancreas, peritoneum, endocrine glands (adrenal, parathyroid, pituitary, testicles, ovary, thymus, thyroid), eye, head and neck, nervous (central and peripheral), lymphatic system, pelvic, skin, soft tissue, spleen, thoracic, and urogenital.

Similarly, other hyperproliferative disorders can also be treated or detected by a polynucleotide or polypeptide of the present invention. Examples of such hyperproliferative disorders include, but are not limited to: hypergammaglobulinemia, lymphoproliferative disorders, paraproteinemias, purpura, sarcoidosis, Sezary Syndrome, Waldenstron's Macroglobulinemia, Gaucher's Disease, histiocytosis, and any other hyperproliferative disease, besides neoplasia, located in an organ system listed above.

Infectious Disease

A polypeptide or polynucleotide of the present invention can be used to treat or detect infectious agents. For example, by increasing the immune response, particularly increasing the proliferation and differentiation of B and/or T cells, infectious diseases may be treated. The immune response may be increased by either enhancing an existing immune response, or by initiating a new immune response. Alternatively, the polypeptide or polynucleotide of the present invention may also directly inhibit the infectious agent, without necessarily eliciting an immune response.

Viruses are one example of an infectious agent that can cause disease or symptoms that can be treated or detected by a polynucleotide or polypeptide of the present invention. Examples of viruses, include, but are not limited to the following DNA and RNA viral families: Arbovirus, Adenoviridae, Arenaviridae, Arterivirus, Birnaviridae, Bunyaviridae, Caliciviridae, Circoviridae, Coronaviridae, Flaviviridae, Hepadnaviridae (Hepatitis), Herpesviridae (such as, Cytomegalovirus, Herpes Simplex, Herpes Zoster), Mononegavirus (e.g., Paramyxoviridae, Morbillivirus, Rhabdoviridae), Orthomyxoviridae (e.g., Influenza), Papovaviridae, Parvoviridae, Picornaviridae, Poxviridae (such as Smallpox or Vaccinia), Reoviridae (e.g., Rotavirus), Retroviridae (HTLV-I, HTLV-II, Lentivirus), and Togaviridae (e.g., Rubivirus). Viruses falling within these families can cause a variety of diseases or symptoms, including, but not limited to: arthritis, bronchiollitis, encephalitis, eye infections (e.g., conjunctivitis, keratitis), chronic fatigue syndrome, hepatitis (A, B, C, E, Chronic Active, Delta), meningitis, opportunistic infections (e.g., AIDS), pneumonia, Burkitt's Lymphoma, chickenpox, hemorrhagic fever, Measles, Mumps, Parainfluenza, Rabies, the common cold, Polio, leukemia, Rubella, sexually transmitted diseases, skin diseases (e.g., Kaposi's, warts), and viremia. A polypeptide or polynucleotide of the present invention can be used to treat or detect any of these symptoms or diseases.

Similarly, bacterial or fungal agents that can cause disease or symptoms and that can be treated or detected by a polynucleotide or polypeptide of the present invention include, but not limited to, the following Gram-Negative and Gram-positive bacterial families and fungi: Actinomycetales (e.g., Corynebacterium, Mycobacterium, Norcardia), Aspergillosis, Bacillaceae (e.g., Anthrax, Clostridium), Bacteroidaceae, Blastomycosis, Bordetella, Borrelia, Brucellosis, Candidiasis, Campylobacter, Coccidioidomycosis, Cryptococcosis, Dermatocycoses, Enterobacteriaceae (Klebsiella, Salmonella, Serratia, Yersinia), Erysipelothrix, Helicobacter, Legionellosis, Leptospirosis, Listeria, Mycoplasmatales, Neisseriaceae (e.g., Acinetobacter, Gonorrhea, Menigococcal), Pasteurellacea Infections (e.g., Actinobacillus, Heamophilus, Pasteurella), Pseudomonas, Rickettsiaceae, Chlamydiaceae, Syphilis, and Staphylococcal. These bacterial or fungal families can cause the following diseases or symptoms, including, but not limited to: bacteremia, endocarditis, eye infections (conjunctivitis, tuberculosis, uveitis), gingivitis, opportunistic infections (e.g., AIDS related infections), paronychia, prosthesis-related infections, Reiter's Disease, respiratory tract infections, such as Whooping Cough or Empyema, sepsis, Lyme Disease, Cat-Scratch Disease, Dysentery, Paratyphoid Fever, food poisoning, Typhoid, pneumonia, Gonorrhea, meningitis, Chlamydia, Syphilis, Diphtheria, Leprosy, Paratuberculosis, Tuberculosis, Lupus, Botulism, gangrene, tetanus, impetigo, Rheumatic Fever, Scarlet Fever, sexually transmitted diseases, skin diseases (e.g., cellulitis, dermatocycoses), toxemia, urinary tract infections, wound infections. A polypeptide or polynucleotide of the present invention can be used to treat or detect any of these symptoms or diseases.

Moreover, parasitic agents causing disease or symptoms that can be treated or detected by a polynucleotide or polypeptide of the present invention include, but not limited to, the following families: Amebiasis, Babesiosis, Coccidiosis, Cryptosporidiosis, Dientamoebiasis, Dourine, Ectoparasitic, Giardiasis, Helminthiasis, Leishmaniasis, Theileriasis, Toxoplasmosis, Trypanosomiasis, and Trichomonas. These parasites can cause a variety of diseases or symptoms, including, but not limited to: Scabies, Trombiculiasis, eye infections, intestinal disease (e.g., dysentery, giardiasis), liver disease, lung disease, opportunistic infections (e.g., AIDS related), Malaria, pregnancy complications, and toxoplasmosis. A polypeptide or polynucleotide of the present invention can be used to treat or detect any of these symptoms or diseases.

Preferably, treatment using a polypeptide or polynucleotide of the present invention could either be by administering an effective amount of a polypeptide to the patient, or by removing cells from the patient, supplying the cells with a polynucleotide of the present invention, and returning the engineered cells to the patient (ex vivo therapy). Moreover, the polypeptide or polynucleotide of the present invention can be used as an antigen in a vaccine to raise an immune response against infectious disease.

Regeneration

A polynucleotide or polypeptide of the present invention can be used to differentiate, proliferate, and attract cells, leading to the regeneration of tissues. (See, Science 276:59–87 (1997).) The regeneration of tissues could be used to repair, replace, or protect tissue damaged by congenital defects, trauma (wounds, burns, incisions, or ulcers), age, disease (e.g. osteoporosis, osteocarthritis, periodontal disease, liver failure), surgery, including cosmetic plastic surgery, fibrosis, reperfusion injury, or systemic cytokine damage.

Tissues that could be regenerated using the present invention include organs (e.g., pancreas, liver, intestine, kidney, skin, endothelium), muscle (smooth, skeletal or cardiac), vascular (including vascular endothelium), nervous, hematopoietic, and skeletal (bone, cartilage, tendon, and ligament) tissue. Preferably, regeneration occurs without or decreased scarring. Regeneration also may include angiogenesis.

Moreover, a polynucleotide or polypeptide of the present invention may increase regeneration of tissues difficult to heal. For example, increased tendon/ligament regeneration would quicken recovery time after damage. A polynucleotide or polypeptide of the present invention could also be used prophylactically in an effort to avoid damage. Specific diseases that could be treated include of tendinitis, carpal tunnel syndrome, and other tendon or ligament defects. A further example of tissue regeneration of non-healing wounds includes pressure ulcers, ulcers associated with vascular insufficiency, surgical, and traumatic wounds.

Similarly, nerve and brain tissue could also be regenerated by using a polynucleotide or polypeptide of the present invention to proliferate and differentiate nerve cells. Diseases that could be treated using this method include central and peripheral nervous system diseases, neuropathies, or mechanical and traumatic disorders (e.g., spinal cord disorders, head trauma, cerebrovascular disease, and stoke). Specifically, diseases associated with peripheral nerve injuries, peripheral neuropathy (e.g., resulting from chemotherapy or other medical therapies), localized neuropathies, and central nervous system diseases (e.g., Alzheimer's disease, Parkinson's disease, Huntington's disease, amyotrophic lateral sclerosis, and Shy-Drager syndrome), could all be treated using the polynucleotide or polypeptide of the present invention.

Chemotaxis

A polynucleotide or polypeptide of the present invention may have chemotaxis activity. A chemotaxic molecule attracts or mobilizes cells (e.g., monocytes, fibroblasts, neutrophils, T-cells, mast cells, eosinophils, epithelial and/or endothelial cells) to a particular site in the body, such as inflammation, infection, or site of hyperproliferation. The mobilized cells can then fight off and/or heal the particular trauma or abnormality.

A polynucleotide or polypeptide of the present invention may increase chemotaxic activity of particular cells. These chemotactic molecules can then be used to treat inflammation, infection, hyperproliferative disorders, or any immune system disorder by increasing the number of cells targeted to a particular location in the body. For example, chemotaxic molecules can be used to treat wounds and other trauma to tissues by attracting immune cells to the injured location. Chemotactic molecules of the present invention can also attract fibroblasts, which can be used to treat wounds.

It is also contemplated that a polynucleotide or polypeptide of the present invention may inhibit chemotactic activity. These molecules could also be used to treat disorders. Thus, a polynucleotide or polypeptide of the present invention could be used as an inhibitor of chemotaxis.

Binding Activity

A polypeptide of the present invention may be used to screen for molecules that bind to the polypeptide or for molecules to which the polypeptide binds. The binding of the polypeptide and the molecule may activate (agonist), increase, inhibit (antagonist), or decrease activity of the polypeptide or the molecule bound. Examples of such molecules include antibodies, oligonucleotides, proteins (e.g., receptors),or small molecules.

Preferably, the molecule is closely related to the natural ligand of the polypeptide, e.g., a fragment of the ligand, or a natural substrate, a ligand, a structural or functional mimetic. (See, Coligan et al., Current Protocols in Immunology 1(2):Chapter 5 (1991).) Similarly, the molecule can be closely related to the natural receptor to which the polypeptide binds, or at least, a fragment of the receptor capable of being bound by the polypeptide (e.g., active site). In either case, the molecule can be rationally designed using known techniques.

Preferably, the screening for these molecules involves producing appropriate cells which express the polypeptide, either as a secreted protein or on the cell membrane. Preferred cells include cells from mammals, yeast, Drosophila, or *E. coli*. Cells expressing the polypeptide (or cell membrane containing the expressed polypeptide) are then preferably contacted with a test compound potentially containing the molecule to observe binding, stimulation, or inhibition of activity of either the polypeptide or the molecule.

The assay may simply test binding of a candidate compound to the polypeptide, wherein binding is detected by a label, or in an assay involving competition with a labeled competitor. Further, the assay may test whether the candidate compound results in a signal generated by binding to the polypeptide.

Alternatively, the assay can be carried out using cell-free preparations, polypeptide/molecule affixed to a solid support, chemical libraries, or natural product mixtures. The assay may also simply comprise the steps of mixing a candidate compound with a solution containing a polypeptide, measuring polypeptide/molecule activity or binding, and comparing the polypeptide/molecule activity or binding to a standard.

Preferably, an ELISA assay can measure polypeptide level or activity in a sample (e.g., biological sample) using a monoclonal or polyclonal antibody. The antibody can measure polypeptide level or activity by either binding, directly or indirectly, to the polypeptide or by competing with the polypeptide for a substrate.

All of these above assays can be used as diagnostic or prognostic markers. The molecules discovered using these assays can be used to treat disease or to bring about a particular result in a patient (e.g., blood vessel growth) by activating or inhibiting the polypeptide/molecule. Moreover, the assays can discover agents which may inhibit or enhance the production of the polypeptide from suitably manipulated cells or tissues.

Therefore, the invention includes a method of identifying compounds which bind to a polypeptide of the invention comprising the steps of: (a) incubating a candidate binding compound with a polypeptide of the invention; and (b) determining if binding has occurred. Moreover, the invention includes a method of identifying agonists/antagonists comprising the steps of: (a) incubating a candidate compound with a polypeptide of the invention, (b) assaying a biological activity , and (b) determining if a biological activity of the polypeptide has been altered.

Other Activities

A polypeptide or polynucleotide of the present invention may also increase or decrease the differentiation or proliferation of embryonic stem cells, besides, as discussed above, hematopoietic lineage.

A polypeptide or polynucleotide of the present invention may also be used to modulate mammalian characteristics, such as body height, weight, hair color, eye color, skin, percentage of adipose tissue, pigmentation, size, and shape (e.g., cosmetic surgery). Similarly, a polypeptide or polynucleotide of the present invention may be used to modulate mammalian metabolism affecting catabolism, anabolism, processing, utilization, and storage of energy.

A polypeptide or polynucleotide of the present invention may be used to change a mammal's mental state or physical state by influencing biorhythms, caricadic rhythms, depression (including depressive disorders), tendency for violence, tolerance for pain, reproductive capabilities (preferably by Activin or Inhibin-like activity), hormonal or endocrine levels, appetite, libido, memory, stress, or other cognitive qualities.

A polypeptide or polynucleotide of the present invention may also be used as a food additive or preservative, such as to increase or decrease storage capabilities, fat content, lipid, protein, carbohydrate, vitamins, minerals, cofactors or other nutritional components.

Other Preferred Embodiments

Other preferred embodiments of the claimed invention include an isolated nucleic acid molecule comprising a nucleotide sequence which is at least 95% identical to a sequence of at least about 50 contiguous nucleotides in the nucleotide sequence of SEQ ID NO:X wherein X is any integer as defined in Table 1.

Also preferred is a nucleic acid molecule wherein said sequence of contiguous nucleotides is included in the nucleotide sequence of SEQ ID NO:X in the range of positions beginning with the nucleotide at about the position of the 5' Nucleotide of the Clone Sequence and ending with the nucleotide at about the position of the 3' Nucleotide of the Clone Sequence as defined for SEQ ID NO:X in Table 1.

Also preferred is a nucleic acid molecule wherein said sequence of contiguous nucleotides is included in the nucleotide sequence of SEQ ID NO:X in the range of positions beginning with the nucleotide at about the position of the 5' Nucleotide of the Start Codon and ending with the nucleotide at about the position of the 3' Nucleotide of the Clone Sequence as defined for SEQ ID NO:X in Table 1.

Similarly preferred is a nucleic acid molecule wherein said sequence of contiguous nucleotides is included in the nucleotide sequence of SEQ ID NO:X in the range of positions beginning with the nucleotide at about the position of the 5' Nucleotide of the First Amino Acid of the Signal Peptide and ending with the nucleotide at about the position of the 3' Nucleotide of the Clone Sequence as defined for SEQ ID NO:X in Table 1.

Also preferred is an isolated nucleic acid molecule comprising a nucleotide sequence which is at least 95% identical to a sequence of at least about 150 contiguous nucleotides in the nucleotide sequence of SEQ ID NO:X.

Further preferred is an isolated nucleic acid molecule comprising a nucleotide sequence which is at least 95% identical to a sequence of at least about 500 contiguous nucleotides in the nucleotide sequence of SEQ ID NO:X.

A further preferred embodiment is a nucleic acid molecule comprising a nucleotide sequence which is at least 95% identical to the nucleotide sequence of SEQ ID NO:X beginning with the nucleotide at about the position of the 5' Nucleotide of the First Amino Acid of the Signal Peptide and ending with the nucleotide at about the position of the 3' Nucleotide of the Clone Sequence as defined for SEQ ID NO:X in Table 1.

A further preferred embodiment is an isolated nucleic acid molecule comprising a nucleotide sequence which is at least 95% identical to the complete nucleotide sequence of SEQ ID NO:X.

Also preferred is an isolated nucleic acid molecule which hybridizes under stringent hybridization conditions to a nucleic acid molecule, wherein said nucleic acid molecule which hybridizes does not hybridize under stringent hybridization conditions to a nucleic acid molecule having a nucleotide sequence consisting of only A residues or of only T residues.

Also preferred is a composition of matter comprising a DNA molecule which comprises a human cDNA clone identified by a cDNA Clone Identifier in Table 1, which DNA molecule is contained in the material deposited with the American Type Culture Collection and given the ATCC Deposit Number shown in Table 1 for said cDNA Clone Identifier.

Also preferred is an isolated nucleic acid molecule comprising a nucleotide sequence which is at least 95% identical to a sequence of at least 50 contiguous nucleotides in the nucleotide sequence of a human cDNA clone identified by a cDNA Clone Identifier in Table 1, which DNA molecule is contained in the deposit given the ATCC Deposit Number shown in Table 1.

Also preferred is an isolated nucleic acid molecule, wherein said sequence of at least 50 contiguous nucleotides is included in the nucleotide sequence of the complete open reading frame sequence encoded by said human cDNA clone.

Also preferred is an isolated nucleic acid molecule comprising a nucleotide sequence which is at least 95% identical to sequence of at least 150 contiguous nucleotides in the nucleotide sequence encoded by said human cDNA clone.

A further preferred embodiment is an isolated nucleic acid molecule comprising a nucleotide sequence which is at least 95% identical to sequence of at least 500 contiguous nucleotides in the nucleotide sequence encoded by said human cDNA clone.

A further preferred embodiment is an isolated nucleic acid molecule comprising a nucleotide sequence which is at least 95% identical to the complete nucleotide sequence encoded by said human cDNA clone.

A further preferred embodiment is a method for detecting in a biological sample a nucleic acid molecule comprising a nucleotide sequence which is at least 95% identical to a sequence of at least 50 contiguous nucleotides in a sequence selected from the group consisting of: a nucleotide sequence of SEQ ID NO:X wherein X is any integer as defined in Table 1; and a nucleotide sequence encoded by a human cDNA clone identified by a cDNA Clone Identifier in Table 1 and contained in the deposit with the ATCC Deposit Number shown for said cDNA clone in Table 1; which method comprises a step of comparing a nucleotide sequence of at least one nucleic acid molecule in said sample with a sequence selected from said group and determining whether the sequence of said nucleic acid molecule in said sample is at least 95% identical to said selected sequence.

Also preferred is the above method wherein said step of comparing sequences comprises determining the extent of nucleic acid hybridization between nucleic acid molecules in said sample and a nucleic acid molecule comprising said sequence selected from said group. Similarly, also preferred is the above method wherein said step of comparing sequences is performed by comparing the nucleotide sequence determined from a nucleic acid molecule in said sample with said sequence selected from said group. The nucleic acid molecules can comprise DNA molecules or RNA molecules.

A further preferred embodiment is a method for identifying the species, tissue or cell type of a biological sample which method comprises a step of detecting nucleic acid molecules in said sample, if any, comprising a nucleotide sequence that is at least 95% identical to a sequence of at least 50 contiguous nucleotides in a sequence selected from the group consisting of: a nucleotide sequence of SEQ ID NO:X wherein X is any integer as defined in Table 1; and a nucleotide sequence encoded by a human cDNA clone identified by a cDNA Clone Identifier in Table 1 and contained in the deposit with the ATCC Deposit Number shown for said cDNA clone in Table 1.

The method for identifying the species, tissue or cell type of a biological sample can comprise a step of detecting nucleic acid molecules comprising a nucleotide sequence in a panel of at least two nucleotide sequences, wherein at least one sequence in said panel is at least 95% identical to a sequence of at least 50 contiguous nucleotides in a sequence selected from said group.

Also preferred is a method for diagnosing in a subject a pathological condition associated with abnormal structure or expression of a gene encoding a secreted protein identified in Table 1, which method comprises a step of detecting in a biological sample obtained from said subject nucleic acid molecules, if any, comprising a nucleotide sequence that is at least 95% identical to a sequence of at least 50 contiguous nucleotides in a sequence selected from the group consisting of: a nucleotide sequence of SEQ ID NO:X wherein X is any integer as defined in Table 1; and a nucleotide sequence encoded by a human cDNA clone identified by a cDNA Clone Identifier in Table 1 and contained in the deposit with the ATCC Deposit Number shown for said cDNA clone in Table 1.

The method for diagnosing a pathological condition can comprise a step of detecting nucleic acid molecules comprising a nucleotide sequence in a panel of at least two nucleotide sequences, wherein at least one sequence in said panel is at least 95% identical to a sequence of at least 50 contiguous nucleotides in a sequence selected from said group.

Also preferred is a composition of matter comprising isolated nucleic acid molecules wherein the nucleotide sequences of said nucleic acid molecules comprise a panel of at least two nucleotide sequences, wherein at least one sequence in said panel is at least 95% identical to a sequence of at least 50 contiguous nucleotides in a sequence selected from the group consisting of: a nucleotide sequence of SEQ ID NO:X wherein X is any integer as defined in Table 1; and a nucleotide sequence encoded by a human cDNA clone identified by a cDNA Clone Identifier in Table 1 and contained in the deposit with the ATCC Deposit Number shown for said cDNA clone in Table 1. The nucleic acid molecules can comprise DNA molecules or RNA molecules.

Also preferred is an isolated polypeptide comprising an amino acid sequence at least 90% identical to a sequence of at least about 10 contiguous amino acids in the amino acid sequence of SEQ ID NO:Y wherein Y is any integer as defined in Table 1.

Also preferred is a polypeptide, wherein said sequence of contiguous amino acids is included in the amino acid sequence of SEQ ID NO:Y in the range of positions beginning with the residue at about the position of the First Amino Acid of the Secreted Portion and ending with the residue at about the Last Amino Acid of the Open Reading Frame as set forth for SEQ ID NO:Y in Table 1.

Also preferred is an isolated polypeptide comprising an amino acid sequence at least 95% identical to a sequence of at least about 30 contiguous amino acids in the amino acid sequence of SEQ ID NO:Y.

Further preferred is an isolated polypeptide comprising an amino acid sequence at least 95% identical to a sequence of at least about 100 contiguous amino acids in the amino acid sequence of SEQ ID NO:Y.

Further preferred is an isolated polypeptide comprising an amino acid sequence at least 95% identical to the complete amino acid sequence of SEQ ID NO:Y.

Further preferred is an isolated polypeptide comprising an amino acid sequence at least 90% identical to a sequence of at least about 10 contiguous amino acids in the complete amino acid sequence of a secreted protein encoded by a human cDNA clone identified by a cDNA Clone Identifier in Table 1 and contained in the deposit with the ATCC Deposit Number shown for said cDNA clone in Table 1.

Also preferred is a polypeptide wherein said sequence of contiguous amino acids is included in the amino acid sequence of a secreted portion of the secreted protein encoded by a human cDNA clone identified by a cDNA Clone Identifier in Table 1 and contained in the deposit with the ATCC Deposit Number shown for said cDNA clone in Table 1.

Also preferred is an isolated polypeptide comprising an amino acid sequence at least 95% identical to a sequence of at least about 30 contiguous amino acids in the amino acid sequence of the secreted portion of the protein encoded by a human cDNA clone identified by a cDNA Clone Identifier in Table 1 and contained in the deposit with the ATCC Deposit Number shown for said cDNA clone in Table 1.

Also preferred is an isolated polypeptide comprising an amino acid sequence at least 95% identical to a sequence of at least about 100 contiguous amino acids in the amino acid sequence of the secreted portion of the protein encoded by a human cDNA clone identified by a cDNA Clone Identifier in Table 1 and contained in the deposit with the ATCC Deposit Number shown for said cDNA clone in Table 1.

Also preferred is an isolated polypeptide comprising an amino acid sequence at least 95% identical to the amino acid sequence of the secreted portion of the protein encoded by a human cDNA clone identified by a cDNA Clone Identifier in Table 1 and contained in the deposit with the ATCC Deposit Number shown for said cDNA clone in Table 1.

Further preferred is an isolated antibody which binds specifically to a polypeptide comprising an amino acid sequence that is at least 90% identical to a sequence of at least 10 contiguous amino acids in a sequence selected from the group consisting of: an amino acid sequence of SEQ ID NO:Y wherein Y is any integer as defined in Table 1; and a complete amino acid sequence of a protein encoded by a human cDNA clone identified by a cDNA Clone Identifier in Table 1 and contained in the deposit with the ATCC Deposit Number shown for said cDNA clone in Table 1.

Further preferred is a method for detecting in a biological sample a polypeptide comprising an amino acid sequence which is at least 90% identical to a sequence of at least 10 contiguous amino acids in a sequence selected from the group consisting of: an amino acid sequence of SEQ ID NO:Y wherein Y is any integer as defined in Table 1; and a complete amino acid sequence of a protein encoded by a human cDNA clone identified by a cDNA Clone Identifier in Table 1 and contained in the deposit with the ATCC Deposit Number shown for said cDNA clone in Table 1; which method comprises a step of comparing an amino acid sequence of at least one polypeptide molecule in said sample with a sequence selected from said group and determining whether the sequence of said polypeptide molecule in said sample is at least 90% identical to said sequence of at least 10 contiguous amino acids.

Also preferred is the above method wherein said step of comparing an amino acid sequence of at least one polypeptide molecule in said sample with a sequence selected from said group comprises determining the extent of specific binding of polypeptides in said sample to an antibody which binds specifically to a polypeptide comprising an amino acid sequence that is at least 90% identical to a sequence of at least 10 contiguous amino acids in a sequence selected from the group consisting of: an amino acid sequence of SEQ ID NO:Y wherein Y is any integer as defined in Table 1; and a complete amino acid sequence of a protein encoded by a human cDNA clone identified by a cDNA Clone Identifier in Table 1 and contained in the deposit with the ATCC Deposit Number shown for said cDNA clone in Table 1.

Also preferred is the above method wherein said step of comparing sequences is performed by comparing the amino acid sequence determined from a polypeptide molecule in said sample with said sequence selected from said group.

Also preferred is a method for identifying the species, tissue or cell type of a biological sample which method comprises a step of detecting polypeptide molecules in said sample, if any, comprising an amino acid sequence that is at least 90% identical to a sequence of at least 10 contiguous amino acids in a sequence selected from the group consisting of: an amino acid sequence of SEQ ID NO:Y wherein Y is any integer as defined in Table 1; and a complete amino acid sequence of a secreted protein encoded by a human cDNA clone identified by a cDNA Clone Identifier in Table 1 and contained in the deposit with the ATCC Deposit Number shown for said cDNA clone in Table 1.

Also preferred is the above method for identifying the species, tissue or cell type of a biological sample, which method comprises a step of detecting polypeptide molecules comprising an amino acid sequence in a panel of at least two amino acid sequences, wherein at least one sequence in said panel is at least 90% identical to a sequence of at least 10 contiguous amino acids in a sequence selected from the above group.

Also preferred is a method for diagnosing in a subject a pathological condition associated with abnormal structure or expression of a gene encoding a secreted protein identified in Table 1, which method comprises a step of detecting in a biological sample obtained from said subject polypeptide molecules comprising an amino acid sequence in a panel of at least two amino acid sequences, wherein at least one sequence in said panel is at least 90% identical to a sequence of at least 10 contiguous amino acids in a sequence selected from the group consisting of: an amino acid sequence of SEQ ID NO:Y wherein Y is any integer as defined in Table 1; and a complete amino acid sequence of a secreted protein encoded by a human cDNA clone identified by a cDNA Clone Identifier in Table 1 and contained in the deposit with the ATCC Deposit Number shown for said cDNA clone in Table 1.

In any of these methods, the step of detecting said polypeptide molecules includes using an antibody.

Also preferred is an isolated nucleic acid molecule comprising a nucleotide sequence which is at least 95% identical to a nucleotide sequence encoding a polypeptide wherein said polypeptide comprises an amino acid sequence that is at least 90% identical to a sequence of at least 10 contiguous amino acids in a sequence selected from the group consisting of: an amino acid sequence of SEQ ID NO:Y wherein Y is any integer as defined in Table 1; and a complete amino acid sequence of a secreted protein encoded by a human cDNA clone identified by a cDNA Clone Identifier in Table 1 and contained in the deposit with the ATCC Deposit Number shown for said cDNA clone in Table 1.

Also preferred is an isolated nucleic acid molecule, wherein said nucleotide sequence encoding a polypeptide has been optimized for expression of said polypeptide in a prokaryotic host.

Also preferred is an isolated nucleic acid molecule, wherein said polypeptide comprises an amino acid sequence selected from the group consisting of: an amino acid sequence of SEQ ID NO:Y wherein Y is any integer as defined in Table 1; and a complete amino acid sequence of a secreted protein encoded by a human cDNA clone identified by a cDNA Clone Identifier in Table 1 and contained in the deposit with the ATCC Deposit Number shown for said cDNA clone in Table 1.

Further preferred is a method of making a recombinant vector comprising inserting any of the above isolated nucleic acid molecule into a vector. Also preferred is the recombinant vector produced by this method. Also preferred is a method of making a recombinant host cell comprising introducing the vector into a host cell, as well as the recombinant host cell produced by this method.

Also preferred is a method of making an isolated polypeptide comprising culturing this recombinant host cell under conditions such that said polypeptide is expressed and recovering said polypeptide. Also preferred is this method of making an isolated polypeptide, wherein said recombinant host cell is a eukaryotic cell and said polypeptide is a secreted portion of a human secreted protein comprising an amino acid sequence selected from the group consisting of: an amino acid sequence of SEQ ID NO:Y beginning with the residue at the position of the First Amino Acid of the Secreted Portion of SEQ ID NO:Y wherein Y is an integer set forth in Table 1 and said position of the First Amino Acid of the Secreted Portion of SEQ ID NO:Y is defined in Table 1; and an amino acid sequence of a secreted portion of a protein encoded by a human cDNA clone identified by a cDNA Clone Identifier in Table 1 and contained in the deposit with the ATCC Deposit Number shown for said cDNA clone in Table 1. The isolated polypeptide produced by this method is also preferred.

Also preferred is a method of treatment of an individual in need of an increased level of a secreted protein activity, which method comprises administering to such an individual a pharmaceutical composition comprising an amount of an isolated polypeptide, polynucleotide, or antibody of the claimed invention effective to increase the level of said protein activity in said individual.

Having generally described the invention, the same will be more readily understood by reference to the following examples, which are provided by way of illustration and are not intended as limiting.

EXAMPLES

Example 1
Isolation of a Selected cDNA Clone from the Deposited Sample

Each cDNA clone in a cited ATCC deposit is contained in a plasmid vector. Table 1 identifies the vectors used to construct the cDNA library from which each clone was isolated. In many cases, the vector used to construct the library is a phage vector from which a plasmid has been excised. The table immediately below correlates the related plasmid for each phage vector used in constructing the cDNA library. For example, where a particular clone is identified in Table 1 as being isolated in the vector "Lambda Zap," the corresponding deposited clone is in "pBluescript."

| Vector Used to Construct Library | Corresponding Deposited Plasmid |
|---|---|
| Lambda Zap | pBluescript (pBS) |
| Uni-Zap XR | pBluescript (pBS) |
| Zap Express | pBK |
| lafmid BA | plafmid BA |
| pSport1 | pSport1 |
| pCMVSport 2.0 | pCMVSport 2.0 |
| pCMVSport 3.0 | pCMVSport 3.0 |
| pCR ® 2.1 | pCR ®2.1 |

Vectors Lambda Zap (U.S. Pat. Nos. 5,128,256 and 5,286,636), Uni-Zap XR (U.S. Pat. Nos. 5,128,256 and 5,286,636), Zap Express (U.S. Pat. Nos. 5,128,256 and 5,286,636), pBluescript (pBS) (Short, J. M. et al., Nucleic Acids Res. 16:7583–7600 (1988); Alting-Mees, M. A. and Short, J. M., Nucleic Acids Res. 17:9494 (1989)) and pBK (Alting-Mees, M. A. et al., Strategies 5:58–61 (1992)) are commercially available from Stratagene Cloning Systems, Inc., 11011 N. Torrey Pines Road, La Jolla, Calif., 92037. pBS contains an ampicillin resistance gene and pBK contains a neomycin resistance gene. Both can be transformed into E. coli strain XL-1 Blue, also available from Stratagene. pBS comes in 4 forms SK+, SK−, KS+and KS. The S and K refers to the orientation of the polylinker to the T7 and T3 primer sequences which flank the polylinker region ("S" is for SacI and "K" is for KpnI which are the first sites on each respective end of the linker). "+" or "−" refer to the orientation of the fl origin of replication ("ori"), such that in one orientation, single stranded rescue initiated from the f1 ori generates sense strand DNA and in the other, antisense.

Vectors pSport1, pCMVSport 2.0 and pCMVSport 3.0, were obtained from Life Technologies, Inc., P. O. Box 6009, Gaithersburg, Md. 20897. All Sport vectors contain an ampicillin resistance gene and may be transformed into E. coli strain DH10B, also available from Life Technologies. (See, for instance, Gruber, C. E., et al., Focus 15:59 (1993).) Vector lafmid BA (Bento Soares, Columbia University, NY) contains an ampicillin resistance gene and can be transformed into E. coli strain XL-1 Blue. Vector pCR®2.1, which is available from Invitrogen, 1600 Faraday Avenue, Carlsbad, Calif. 92008, contains an ampicillin resistance gene and may be transformed into E. coli strain DH10B, available from Life Technologies. (See, for instance, Clark, J. M., Nuc. Acids Res. 16:9677–9686 (1988) and Mead, D. et al., Bio/Technology 9: (1991).) Preferably, a polynucleotide of the present invention does not comprise the phage vector sequences identified for the particular clone in Table 1, as well as the corresponding plasmid vector sequences designated above.

The deposited material in the sample assigned the ATCC Deposit Number cited in Table 1 for any given cDNA clone also may contain one or more additional plasmids, each comprising a cDNA clone different from that given clone. Thus, deposits sharing the same ATCC Deposit Number contain at least a plasmid for each cDNA clone identified in Table 1. Typically, each ATCC deposit sample cited in Table 1 comprises a mixture of approximately equal amounts (by weight) of about 50 plasmid DNAs, each containing a different cDNA clone; but such a deposit sample may include plasmids for more or less than 50 cDNA clones, up to about 500 cDNA clones.

Two approaches can be used to isolate a particular clone from the deposited sample of plasmid DNAs cited for that clone in Table 1. First, a plasmid is directly isolated by screening the clones using a polynucleotide probe corresponding to SEQ ID NO:X.

Particularly, a specific polynucleotide with 30–40 nucleotides is synthesized using an Applied Biosystems DNA synthesizer according to the sequence reported. The oligonucleotide is labeled, for instance, with $^{32}$P-γ-ATP using T4 polynucleotide kinase and purified according to routine methods. (E.g., Maniatis et al., Molecular Cloning: A Laboratory Manual, Cold Spring Harbor Press, Cold Spring, N.Y. (1982).) The plasmid mixture is transformed into a suitable host, as indicated above (such as XL-1 Blue (Stratagene)) using techniques known to those of skill in the art, such as those provided by the vector supplier or in related publications or patents cited above. The transformants are plated on 1.5% agar plates (containing the appropriate selection agent, e.g., ampicillin) to a density of about 150 transformants (colonies) per plate. These plates are screened using Nylon membranes according to routine methods for bacterial colony screening (e.g., Sambrook et al., Molecular Cloning:

A Laboratory Manual, 2nd Edit., (1989), Cold Spring Harbor Laboratory Press, pages 1.93 to 1.104), or other techniques known to those of skill in the art.

Alternatively, two primers of 17–20 nucleotides derived from both ends of the SEQ ID NO:X (i.e., within the region of SEQ ID NO:X bounded by the 5' NT and the 3' NT of the clone defined in Table 1) are synthesized and used to amplify the desired cDNA using the deposited cDNA plasmid as a template. The polymerase chain reaction is carried out under routine conditions, for instance, in 25 $\mu$l of reaction mixture with 0.5 ug of the above cDNA template. A convenient reaction mixture is 1.5–5 mM $MgCl_2$, 0.01% (w/v) gelatin, 20 $\mu$M each of dATP, dCTP, dGTP, dTTP, 25 pmol of each primer and 0.25 Unit of Taq polymerase. Thirty five cycles of PCR (denaturation at 94° C. for 1 min; annealing at 55° C. for 1 min; elongation at 72° C. for 1 min) are performed with a Perkin-Elmer Cetus automated thermal cycler. The amplified product is analyzed by agarose gel electrophoresis and the DNA band with expected molecular weight is excised and purified. The PCR product is verified to be the selected sequence by subcloning and sequencing the DNA product.

Several methods are available for the identification of the 5' or 3' non-coding portions of a gene which may not be present in the deposited clone. These methods include but are not limited to, filter probing, clone enrichment using specific probes, and protocols similar or identical to 5' and 3' "RACE" protocols which are well known in the art. For instance, a method similar to 5' RACE is available for generating the missing 5' end of a desired full-length transcript. (Fromont-Racine et al., Nucleic Acids Res. 21(7):1683–1684 (1993).)

Briefly, a specific RNA oligonucleotide is ligated to the 5' ends of a population of RNA presumably containing full-length gene RNA transcripts. A primer set containing a primer specific to the ligated RNA oligonucleotide and a primer specific to a known sequence of the gene of interest is used to PCR amplify the 5' portion of the desired full-length gene. This amplified product may then be sequenced and used to generate the full length gene.

This above method starts with total RNA isolated from the desired source, although poly-A+ RNA can be used. The RNA preparation can then be treated with phosphatase if necessary to eliminate 5' phosphate groups on degraded or damaged RNA which may interfere with the later RNA ligase step. The phosphatase should then be inactivated and the RNA treated with tobacco acid pyrophosphatase in order to remove the cap structure present at the 5' ends of messenger RNAs. This reaction leaves a 5' phosphate group at the 5' end of the cap cleaved RNA which can then be ligated to an RNA oligonucleotide using T4 RNA ligase.

This modified RNA preparation is used as a template for first strand cDNA synthesis using a gene specific oligonucleotide. The first strand synthesis reaction is used as a template for PCR amplification of the desired 5' end using a primer specific to the ligated RNA oligonucleotide and a primer specific to the known sequence of the gene of interest. The resultant product is then sequenced and analyzed to confirm that the 5' end sequence belongs to the desired gene.

Example 2
Isolation of Genomic Clones Corresponding to a Polynucleotide

A human genomic P1 library (Genomic Systems, Inc.) is screened by PCR using primers selected for the cDNA sequence corresponding to SEQ ID NO:X., according to the method described in Example 1. (See also, Sambrook.)

Example 3
Tissue Distribution of Polypeptide

Tissue distribution of MRNA expression of polynucleotides of the present invention is determined using protocols for Northern blot analysis, described by, among others, Sambrook et al. For example, a cDNA probe produced by the method described in Example 1 is labeled with $p^{32}$ using the rediprime™ DNA labeling system (Amersham Life Science), according to manufacturer's instructions. After labeling, the probe is purified using CHROMA SPIN-100™ column (Clontech Laboratories, Inc.), according to manufacturer's protocol number PT 1200-1. The purified labeled probe is then used to examine various human tissues for MRNA expression.

Multiple Tissue Northern (MTN) blots containing various human tissues (H) or human immune system tissues (IM) (Clontech) are examined with the labeled probe using ExpressHyb™ hybridization solution (Clontech) according to manufacturer's protocol number PT1190-1. Following hybridization and washing, the blots are mounted and exposed to film at −70° C. overnight, and the films developed according to standard procedures.

Example 4
Chromosomal Mapping of the Polynucleotides

An oligonucleotide primer set is designed according to the sequence at the 5' end of SEQ ID NO:X. This primer preferably spans about 100 nucleotides. This primer set is then used in a polymerase chain reaction under the following set of conditions: 30 seconds, 95° C.; 1 minute, 56° C.; 1 minute, 70° C. This cycle is repeated 32 times followed by one 5 minute cycle at 70° C. Human, mouse, and hamster DNA is used as template in addition to a somatic cell hybrid panel containing individual chromosomes or chromosome fragments (Bios, Inc). The reactions is analyzed on either 8% polyacrylamide gels or 3.5% agarose gels. Chromosome mapping is determined by the presence of an approximately 100 bp PCR fragment in the particular somatic cell hybrid.

Example 5
Bacterial Expression of a Polypeptide

A polynucleotide encoding a polypeptide of the present invention is amplified using PCR oligonucleotide primers corresponding to the 5' and 3' ends of the DNA sequence, as outlined in Example 1, to synthesize insertion fragments. The primers used to amplify the cDNA insert should preferably contain restriction sites, such as BamHI and XbaI, at the 5' end of the primers in order to clone the amplified product into the expression vector. For example, BamHI and XbaI correspond to the restriction enzyme sites on the bacterial expression vector pQE-9. (Qiagen, Inc., Chatsworth, Calif.). This plasmid vector encodes antibiotic resistance (Amp'), a bacterial origin of replication (ori), an IPTG-regulatable promoter/operator (P/O), a ribosome binding site (RBS), a 6-histidine tag (6-His), and restriction enzyme cloning sites.

The pQE-9 vector is digested with BamHI and XbaI and the amplified fragment is ligated into the pQE-9 vector maintaining the reading frame initiated at the bacterial RBS. The ligation mixture is then used to transform the E. coli strain M15/rep4 (Qiagen, Inc.) which contains multiple copies of the plasmid pREP4, which expresses the lacI repressor and also confers kanamycin resistance (Kan'). Transformants are identified by their ability to grow on LB plates and ampicillin/kanamycin resistant colonies are selected. Plasmid DNA is isolated and confirmed by restriction analysis.

Clones containing the desired constructs are grown overnight (O/N) in liquid culture in LB media supplemented with both Amp (100 ug/ml) and Kan (25 ug/ml). The O/N culture is used to inoculate a large culture at a ratio of 1:100 to 1:250. The cells are grown to an optical density 600 (O.D.$^{600}$) of between 0.4 and 0.6. IPTG (Isopropyl-B-D-thiogalacto pyranoside) is then added to a final concentration of 1 mM. IPTG induces by inactivating the lacI repressor, clearing the P/O leading to increased gene expression.

Cells are grown for an extra 3 to 4 hours. Cells are then harvested by centrifugation (20 mins at 6000×g). The cell pellet is solubilized in the chaotropic agent 6 Molar Guanidine HCl by stirring for 3–4 hours at 4° C. The cell debris is removed by centrifugation, and the supernatant containing the polypeptide is loaded onto a nickel-nitrilo-tri-acetic acid ("Ni-NTA") affinity resin column (available from QIAGEN, Inc., supra). Proteins with a 6×His tag bind to the Ni-NTA resin with high affinity and can be purified in a simple one-step procedure (for details see: The QIAexpressionist (1995) QIAGEN, Inc., supra).

Briefly, the supernatant is loaded onto the column in 6 M guanidine-HCl, pH 8, the column is first washed with 10 volumes of 6 M guanidine-HCl, pH 8, then washed with 10 volumes of 6 M guanidine-HCl pH 6, and finally the polypeptide is eluted with 6 M guanidine-HCl, pH 5.

The purified protein is then renatured by dialyzing it against phosphate-buffered saline (PBS) or 50 mM Na-acetate, pH 6 buffer plus 200 mM NaCl. Alternatively, the protein can be successfully refolded while immobilized on the Ni-NTA column. The recommended conditions are as follows: renature using a linear 6M-1M urea gradient in 500 mM NaCl, 20% glycerol, 20 mM Tris/HCl pH 7.4, containing protease inhibitors. The renaturation should be performed over a period of 1.5 hours or more. After renaturation the proteins are eluted by the addition of 250 mM immidazole. Immidazole is removed by a final dialyzing step against PBS or 50 mM sodium acetate pH 6 buffer plus 200 mM NaCl. The purified protein is stored at 4° C. or frozen at −80° C.

In addition to the above expression vector, the present invention further includes an expression vector comprising phage operator and promoter elements operatively linked to a polynucleotide of the present invention, called pHE4a. (ATCC Accession Number 209645, deposited on Feb. 25, 1998.) This vector contains: 1) a neomycinphosphotransferase gene as a selection marker, 2) an E. coli origin of replication, 3) a T5 phage promoter sequence, 4) two lac operator sequences, 5) a Shine-Delgarno sequence, and 6) the lactose operon repressor gene (lacIq). The origin of replication (oriC) is derived from pUC19 (LTI, Gaithersburg, Md.). The promoter sequence and operator sequences are made synthetically.

DNA can be inserted into the pHEa by restricting the vector with NdeI and XbaI, BamHI, XhoI, or Asp718, running the restricted product on a gel, and isolating the larger fragment (the stuffer fragment should be about 310 base pairs). The DNA insert is generated according to the PCR protocol described in Example 1, using PCR primers having restriction sites for NdeI (5' primer) and XbaI, BamHI, XhoI, or Asp718 (3' primer). The PCR insert is gel purified and restricted with compatible enzymes. The insert and vector are ligated according to standard protocols.

The engineered vector could easily be substituted in the above protocol to express protein in a bacterial system.

Example 6
Purification of a Polypeptide from an Inclusion Body

The following alternative method can be used to purify a polypeptide expressed in E coli when it is present in the form of inclusion bodies. Unless otherwise specified, all of the following steps are conducted at 4–10° C.

Upon completion of the production phase of the E. coli fermentation, the cell culture is cooled to 4–10° C. and the cells harvested by continuous centrifugation at 15,000 rpm (Heraeus Sepatech). On the basis of the expected yield of protein per unit weight of cell paste and the amount of purified protein required, an appropriate amount of cell paste, by weight, is suspended in a buffer solution containing 100 mM Tris, 50 mM EDTA, pH 7.4. The cells are dispersed to a homogeneous suspension using a high shear mixer.

The cells are then lysed by passing the solution through a microfluidizer (Microfuidics, Corp. or APV Gaulin, Inc.) twice at 4000–6000 psi. The homogenate is then mixed with NaCl solution to a final concentration of 0.5 M NaCl, followed by centrifugation at 7000×g for 15 min. The resultant pellet is washed again using 0.5M NaCl, 100 mM Tris, 50 mM EDTA, pH 7.4.

The resulting washed inclusion bodies are solubilized with 1.5 M guanidine hydrochloride (GuHCl) for 2–4 hours. After 7000×g centrifugation for 15 min., the pellet is discarded and the polypeptide containing supernatant is incubated at 4° C. overnight to allow further GuHCl extraction.

Following high speed centrifugation (30,000×g) to remove insoluble particles, the GuHCl solubilized protein is refolded by quickly mixing the GuHCl extract with 20 volumes of buffer containing 50 mM sodium, pH 4.5, 150 mM NaCl, 2 mM EDTA by vigorous stirring. The refolded diluted protein solution is kept at 4° C. without mixing for 12 hours prior to further purification steps.

To clarify the refolded polypeptide solution, a previously prepared tangential filtration unit equipped with 0.16 $\mu$m membrane filter with appropriate surface area (e.g., Filtron), equilibrated with 40 mM sodium acetate, pH 6.0 is employed. The filtered sample is loaded onto a cation exchange resin (e.g., Poros HS-50, Perseptive Biosystems). The column is washed with 40 mM sodium acetate, pH 6.0 and eluted with 250 mM, 500 mM, 1000 mM, and 1500 mM NaCl in the same buffer, in a stepwise manner. The absorbance at 280 nm of the effluent is continuously monitored. Fractions are collected and further analyzed by SDS-PAGE.

Fractions containing the polypeptide are then pooled and mixed with 4 volumes of water. The diluted sample is then loaded onto a previously prepared set of tandem columns of strong anion (Poros HQ-50, Perseptive Biosystems) and weak anion (Poros CM-20, Perseptive Biosystems) exchange resins. The columns are equilibrated with 40 mM sodium acetate, pH 6.0. Both columns are washed with 40 mM sodium acetate, pH 6.0, 200 mM NaCl. The CM-20 column is then eluted using a 10 column volume linear gradient ranging from 0.2 M NaCl, 50 mM sodium acetate, pH 6.0 to 1.0 M NaCl, 50 mM sodium acetate, pH 6.5. Fractions are collected under constant $A_{280}$ monitoring of the effluent. Fractions containing the polypeptide (determined, for instance, by 16% SDS-PAGE) are then pooled.

The resultant polypeptide should exhibit greater than 95% purity after the above refolding and purification steps. No major contaminant bands should be observed from Commassie blue stained 16% SDS-PAGE gel when 5 $\mu$g of purified protein is loaded. The purified protein can also be tested for endotoxin/LPS contamination, and typically the LPS content is less than 0.1 ng/ml according to LAL assays.

Example 7
Cloning and Expression of a Polypeptide in a Baculovirus Expression System In this example, the plasmid shuttle vector pA2 is used to insert a polynucleotide into a baculovirus to express a polypeptide. This expression vector contains the strong polyhedrin promoter of the *Autographa californica* nuclear polyhedrosis virus (AcMNPV) followed by convenient restriction sites such as BamHI, Xba I and Asp718. The polyadenylation site of the simian virus 40 ("SV40") is used for efficient polyadenylation. For easy selection of recombinant virus, the plasmid contains the beta-galactosidase gene from *E coli* under control of a weak Drosophila promoter in the same orientation, followed by the polyadenylation signal of the polyhedrin gene. The inserted genes are flanked on both sides by viral sequences for cell-mediated homologous recombination with wild-type viral DNA to generate a viable virus that express the cloned polynucleotide.

Many other baculovirus vectors can be used in place of the vector above, such as pAc373, pVL941, and pAcIM1, as one skilled in the art would readily appreciate, as long as the construct provides appropriately located signals for transcription, translation, secretion and the like, including a signal peptide and an in-frame AUG as required. Such vectors are described, for instance, in Luckow et al., Virology 170:31–39 (1989).

Specifically, the cDNA sequence contained in the deposited clone, including the AUG initiation codon and the naturally associated leader sequence identified in Table 1, is amplified using the PCR protocol described in Example 1. If the naturally occurring signal sequence is used to produce the secreted protein, the pA2 vector does not need a second signal peptide. Alternatively, the vector can be modified (pA2 GP) to include a baculovirus leader sequence, using the standard methods described in Summers et al., "A Manual of Methods for Baculovirus Vectors and Insect Cell Culture Procedures," Texas Agricultural Experimental Station Bulletin No. 1555 (1987).

The amplified fragment is isolated from a 1% agarose gel using a commercially available kit ("Geneclean," BIO 101 Inc., La Jolla, Calif.). The fragment then is digested with appropriate restriction enzymes and again purified on a 1% agarose gel.

The plasmid is digested with the corresponding restriction enzymes and optionally, can be dephosphorylated using calf intestinal phosphatase, using routine procedures known in the art. The DNA is then isolated from a 1% agarose gel using a commercially available kit ("Geneclean" BIO 101 Inc., La Jolla, Calif.).

The fragment and the dephosphorylated plasmid are ligated together with T4 DNA ligase. *E. coli* HB101 or other suitable *E. coli* hosts such as XL-1 Blue (Stratagene Cloning Systems, La Jolla, Calif.) cells are transformed with the ligation mixture and spread on culture plates. Bacteria containing the plasmid are identified by digesting DNA from individual colonies and analyzing the digestion product by gel electrophoresis. The sequence of the cloned fragment is confirmed by DNA sequencing.

Five $\mu$g of a plasmid containing the polynucleotide is co-transfected with 1.0 $\mu$g of a commercially available linearized baculovirus DNA ("BaculoGold™ baculovirus DNA", Pharmingen, San Diego, Calif.), using the lipofection method described by Felgner et al., Proc. Natl. Acad. Sci. USA 84:7413–7417 (1987). One $\mu$g of BaculoGold™ virus DNA and 5 $\mu$g of the plasmid are mixed in a sterile well of a microtiter plate containing 50 $\mu$l of serum-free Grace's medium (Life Technologies Inc., Gaithersburg, Md.). Afterwards, 10 $\mu$l Lipofectin plus 90 $\mu$l Grace's medium are added, mixed and incubated for 15 minutes at room temperature. Then the transfection mixture is added drop-wise to Sf9 insect cells (ATCC CRL 1711) seeded in a 35 mm tissue culture plate with 1 ml Grace's medium without serum. The plate is then incubated for 5 hours at 27° C. The transfection solution is then removed from the plate and 1 ml of Grace's insect medium supplemented with 10% fetal calf serum is added. Cultivation is then continued at 27° C. for four days.

After four days the supernatant is collected and a plaque assay is performed, as described by Summers and Smith, supra. An agarose gel with "Blue Gal" (Life Technologies Inc., Gaithersburg) is used to allow easy identification and isolation of gal-expressing clones, which produce blue-stained plaques. (A detailed description of a "plaque assay" of this type can also be found in the user's guide for insect cell culture and baculovirology distributed by Life Technologies Inc., Gaithersburg, page 9–10.) After appropriate incubation, blue stained plaques are picked with the tip of a micropipettor (e.g., Eppendorf). The agar containing the recombinant viruses is then resuspended in a microcentrifuge tube containing 200 $\mu$l of Grace's medium and the suspension containing the recombinant baculovirus is used to infect Sf9 cells seeded in 35 mm dishes. Four days later the supernatants of these culture dishes are harvested and then they are stored at 4° C.

To verify the expression of the polypeptide, Sf9 cells are grown in Grace's medium supplemented with 10% heat-inactivated FBS. The cells are infected with the recombinant baculovirus containing the polynucleotide at a multiplicity of infection ("MOI") of about 2. If radiolabeled proteins are desired, 6 hours later the medium is removed and is replaced with SF900 II medium minus methionine and cysteine (available from Life Technologies Inc., Rockville, Md.). After 42 hours, 5 $\mu$Ci of $^{35}$S-methionine and 5 $\mu$Ci $^{35}$S-cysteine (available from Amersham) are added. The cells are further incubated for 16 hours and then are harvested by centrifugation. The proteins in the supernatant as well as the intracellular proteins are analyzed by SDS-PAGE followed by autoradiography (if radiolabeled).

Microsequencing of the amino acid sequence of the amino terminus of purified protein may be used to determine the amino terminal sequence of the produced protein.

Example 8
Expression of a Polypeptide in Mammalian Cells

The polypeptide of the present invention can be expressed in a mammalian cell. A typical mammalian expression vector contains a promoter element, which mediates the initiation of transcription of mRNA, a protein coding sequence, and signals required for the termination of transcription and polyadenylation of the transcript. Additional elements include enhancers, Kozak sequences and intervening sequences flanked by donor and acceptor sites for RNA splicing. Highly efficient transcription is achieved with the early and late promoters from SV40, the long terminal repeats (LTRs) from Retroviruses, e.g., RSV, HTLVI, HIVI and the early promoter of the cytomegalovirus (CMV). However, cellular elements can also be used (e.g., the human actin promoter).

Suitable expression vectors for use in practicing the present invention include, for example, vectors such as pSVL and pMSG (Pharmacia, Uppsala, Sweden), pRSVcat (ATCC 37152), pSV2dhfr (ATCC 37146), pBC12MI (ATCC 67109), pCMVSport 2.0, and pCMVSport 3.0. Mammalian host cells that could be used include, human Hela, 293, H9 and Jurkat cells, mouse NIH3T3 and C127 cells, Cos 1, Cos 7 and CV1, quail QC1-3 cells, mouse L cells and Chinese hamster ovary (CHO) cells.

Alternatively, the polypeptide can be expressed in stable cell lines containing the polynucleotide integrated into a chromosome. The co-transfection with a selectable marker such as dhfr, gpt, neomycin, hygromycin allows the identification and isolation of the transfected cells.

The transfected gene can also be amplified to express large amounts of the encoded protein. The DHFR (dihydrofolate reductase) marker is useful in developing cell lines that carry several hundred or even several thousand copies of the gene of interest. (See, e.g., Alt, F. W., et al., J. Biol. Chem. 253:1357–1370 (1978); Hamlin, J. L. and Ma, C., Biochem. et Biophys. Acta, 1097:107–143 (1990); Page, M. J. and Sydenham, M. A., Biotechnology 9:64–68 (1991).) Another useful selection marker is the enzyme glutamine synthase (GS) (Murphy et al., Biochem J. 227:277–279 (1991); Bebbington et al., Bio/Technology 10:169–175 (1992). Using these markers, the mammalian cells are grown in selective medium and the cells with the highest resistance are selected. These cell lines contain the amplified gene(s) integrated into a chromosome. Chinese hamster ovary (CHO) and NSO cells are often used for the production of proteins.

Derivatives of the plasmid pSV2-dhfr (ATCC Accession No. 37146), the expression vectors pC4 (ATCC Accession No. 209646) and pC6 (ATCC Accession No.209647) contain the strong promoter (LTR) of the Rous Sarcoma Virus (Cullen et al., Molecular and Cellular Biology, 438–447 (March, 1985)) plus a fragment of the CMV-enhancer (Boshart et al., Cell 41:521–530 (1985).) Multiple cloning sites, e.g., with the restriction enzyme cleavage sites BamHI, XbaI and Asp718, facilitate the cloning of the gene of interest. The vectors also contain the 3' intron, the polyadenylation and termination signal of the rat preproinsulin gene, and the mouse DHFR gene under control of the SV40 early promoter.

Specifically, the plasmid pC6, for example, is digested with appropriate restriction enzymes and then dephosphorylated using calf intestinal phosphates by procedures known in the art. The vector is then isolated from a 1% agarose gel.

A polynucleotide of the present invention is amplified according to the protocol outlined in Example 1. If the naturally occurring signal sequence is used to produce the secreted protein, the vector does not need a second signal peptide. Alternatively, if the naturally occurring signal sequence is not used, the vector can be modified to include a heterologous signal sequence. (See, e.g., WO 96/34891.)

The amplified fragment is isolated from a 1% agarose gel using a commercially available kit ("Geneclean," BIO 101 Inc., La Jolla, Calif.). The fragment then is digested with appropriate restriction enzymes and again purified on a 1% agarose gel.

The amplified fragment is then digested with the same restriction enzyme and purified on a 1% agarose gel. The isolated fragment and the dephosphorylated vector are then ligated with T4 DNA ligase. E. coli HB101 or XL-1 Blue cells are then transformed and bacteria are identified that contain the fragment inserted into plasmid pC6 using, for instance, restriction enzyme analysis.

Chinese hamster ovary cells lacking an active DHFR gene is used for transfection. Five µg of the expression plasmid pC6 is cotransfected with 0.5 µg of the plasmid pSVneo using lipofectin (Felgner et al., supra). The plasmid pSV2-neo contains a dominant selectable marker, the neo gene from Tn5 encoding an enzyme that confers resistance to a group of antibiotics including G418. The cells are seeded in alpha minus MEM supplemented with 1 mg/ml G418. After 2 days, the cells are trypsinized and seeded in hybridoma cloning plates (Greiner, Germany) in alpha minus MEM supplemented with 10, 25, or 50 ng/ml of metothrexate plus 1 mg/ml G418. After about 10–14 days single clones are trypsinized and then seeded in 6-well petri dishes or 10 ml flasks using different concentrations of methotrexate (50 nM, 100 nM, 200 nM, 400 nM, 800 nM). Clones growing at the highest concentrations of methotrexate are then transferred to new 6-well plates containing even higher concentrations of methotrexate (1 µM, 2 µM, 5 µM, 10 mM, 20 mM). The same procedure is repeated until clones are obtained which grow at a concentration of 100–200 µM. Expression of the desired gene product is analyzed, for instance, by SDS-PAGE and Western blot or by reversed phase HPLC analysis.

Example 9

Protein Fusions

The polypeptides of the present invention are preferably fused to other proteins. These fusion proteins can be used for a variety of applications. For example, fusion of the present polypeptides to His-tag, HA-tag, protein A, IgG domains, and maltose binding protein facilitates purification. (See Example 5; see also EPA 394,827; Traunecker, et al., Nature 331:84–86 (1988).) Similarly, fusion to IgG-1, IgG-3, and albumin increases the halflife time in vivo. Nuclear localization signals fused to the polypeptides of the present invention can target the protein to a specific subcellular localization, while covalent heterodimer or homodimers can increase or decrease the activity of a fusion protein. Fusion proteins can also create chimeric molecules having more than one function. Finally, fusion proteins can increase solubility and/or stability of the fused protein compared to the non-fused protein. All of the types of fusion proteins described above can be made by modifying the following protocol, which outlines the fusion of a polypeptide to an IgG molecule, or the protocol described in Example 5.

Briefly, the human Fc portion of the IgG molecule can be PCR amplified, using primers that span the 5' and 3' ends of the sequence described below. These primers also should have convenient restriction enzyme sites that will facilitate cloning into an expression vector, preferably a mammalian expression vector.

For example, if pC4 (See Genbank Accession No. 209646) is used, the human Fc portion can be ligated into the BamHI cloning site. Note that the 3' BamHI site should be destroyed. Next, the vector containing the human Fc portion is re-restricted with BamHI, linearizing the vector, and a polynucleotide of the present invention, isolated by the PCR protocol described in Example 1, is ligated into this BamHI site. Note that the polynucleotide is cloned without a stop codon, otherwise a fusion protein will not be produced.

If the naturally occurring signal sequence is used to produce the secreted protein, pC4 does not need a second signal peptide. Alternatively, if the naturally occurring signal sequence is not used, the vector can be modified to include a heterologous signal sequence. (See, e.g., WO 96/34891.)

Human IgG Fc region: GGGATCCGGAGCCCAAATCT-
TCTGACAAAACTCACACATGCCCACCGT-
GCCCAGCACCTGAATTCGAGGGTGCAC- CGTCAGTCTTCCTCTTCCCCCCAAAACCCAAGG
ACACCCTCATGATCTCCCGGACTCCTGAGGTCA
CATGCGTGGTGGTGGACGTAAGCCACGAAGACC
CTGAGGTCAAGTTCAACTGGTACGTGGACGGCG
TGGAGGTGCATAATGCCAAGACAAAGCCGCGGG
AGGAGCAGTACAACAGCACGTACCGTGTGGTCA
GCGTCCTCACCGTCCTGCACCAGGACTGGCTGA
ATGGCAAGGAGTACAAGTGCAAGGTCTCCAACA
AAGCCCTCCAACCCCCATCGAGAAAACCATCT
CCAAAGCCAAAGGGCAGCCCCGAGAAC-
CACAGG TGTACACCCTGCCCCCATCCCGGGAT-
GAGCTGA CCAAGAACCAGGTCAGCCTGACCT-
GCCTGGTCA
AAGGCTTCTATCCAAGCGACATCGCCGTGGAGT
GGGAGAGCAATGGGCAGCCGGAGAACAACTACA
AGACCACGCCTCCCGTGCTGGACTCCGACGGCT
CCTTCTTCCTCTACAGCAAGCTCACCGTGGACA
AGAGCAGGTGGCAGCAGGGGAACGTCTTCTCAT
GCTCCGTGATGCATGAGGCTCTGCACAACCACT
ACACGCAGAAGAGCCTCTCCCTGTCTCCGGGTA
AATGAGTGCGACGGCCGCGACTCTAGAGGAT
(SEQ ID NO:1)

Example 10

Production of an Antibody from a Polypeptide

The antibodies of the present invention can be prepared by a variety of methods. (See, Current Protocols, Chapter 2.) For example, cells expressing a polypeptide of the present invention is administered to an animal to induce the production of sera containing polyclonal antibodies. In a preferred method, a preparation of the secreted protein is prepared and purified to render it substantially free of natural contaminants. Such a preparation is then introduced into an animal in order to produce polyclonal antisera of greater specific activity.

In the most preferred method, the antibodies of the present invention are monoclonal antibodies (or protein binding fragments thereof). Such monoclonal antibodies can be prepared using hybridoma technology. (Köhler et al., Nature 256:495 (1975); Köhler et al., Eur. J. Immunol. 6:511 (1976); Köhler et al., Eur. J. Immunol. 6:292 (1976); Hammerling et al., in: Monoclonal Antibodies and T-Cell Hybridomas, Elsevier, N.Y., pp. 563–681 (1981).) In general, such procedures involve immunizing an animal (preferably a mouse) with polypeptide or, more preferably, with a secreted polypeptide-expressing cell. Such cells may be cultured in any suitable tissue culture medium; however, it is preferable to culture cells in Earle's modified Eagle's medium supplemented with 10% fetal bovine serum (inactivated at about 56° C. ), and supplemented with about 10 g/l of nonessential amino acids, about 1,000 U/ml of penicillin, and about 100 µg/ml of streptomycin.

The splenocytes of such mice are extracted and fused with a suitable myeloma cell line. Any suitable myeloma cell line may be employed in accordance with the present invention; however, it is preferable to employ the parent myeloma cell line (SP2O), available from the ATCC. After fusion, the resulting hybridoma cells are selectively maintained in HAT medium, and then cloned by limiting dilution as described by Wands et al. (Gastroenterology 80:225–232 (1981).) The hybridoma cells obtained through such a selection are then assayed to identify clones which secrete antibodies capable of binding the polypeptide.

Alternatively, additional antibodies capable of binding to the polypeptide can be produced in a two-step procedure using anti-idiotypic antibodies. Such a method makes use of the fact that antibodies are themselves antigens, and therefore, it is possible to obtain an antibody which binds to a second antibody. In accordance with this method, protein specific antibodies are used to immunize an animal, preferably a mouse. The splenocytes of such an animal are then used to produce hybridoma cells, and the hybridoma cells are screened to identify clones which produce an antibody whose ability to bind to the protein-specific antibody can be blocked by the polypeptide. Such antibodies comprise anti-idiotypic antibodies to the protein-specific antibody and can be used to immunize an animal to induce formation of further protein-specific antibodies.

It will be appreciated that Fab and F(ab')2 and other fragments of the antibodies of the present invention may be used according to the methods disclosed herein. Such fragments are typically produced by proteolytic cleavage, using enzymes such as papain (to produce Fab fragments) or pepsin (to produce F(ab')2 fragments). Alternatively, secreted protein-binding fragments can be produced through the application of recombinant DNA technology or through synthetic chemistry.

For in vivo use of antibodies in humans, it may be preferable to use "humanized" chimeric monoclonal antibodies. Such antibodies can be produced using genetic constructs derived from hybridoma cells producing the monoclonal antibodies described above. Methods for producing chimeric antibodies are known in the art. (See, for review, Morrison, Science 229:1202 (1985); Oi et al., BioTechniques 4:214 (1986); Cabilly et al., U.S. Pat. No. 4,816,567; Taniguchi et al., EP 171496; Morrison et al., EP 173494; Neuberger et al., WO 8601533; Robinson et al., WO 8702671; Boulianne et al., Nature 312:643 (1984); Neuberger et al., Nature 314:268 (1985).)

Example 11

Production of Secreted Protein for High-Throughput Screening Assays

The following protocol produces a supernatant containing a polypeptide to be tested. This supernatant can then be used in the Screening Assays described in Examples 13–20.

First, dilute Poly-D-Lysine (644 587 Boehringer-Mannheim) stock solution (1 mg/ml in PBS) 1:20 in PBS (w/o calcium or magnesium 17-516F Biowhittaker) for a working solution of 50 ug/ml. Add 200 ul of this solution to each well (24 well plates) and incubate at RT for 20 minutes. Be sure to distribute the solution over each well (note: a 12-channel pipetter may be used with tips on every other channel). Aspirate off the Poly-D-Lysine solution and rinse with 1 ml PBS (Phosphate Buffered Saline). The PBS should remain in the well until just prior to plating the cells and plates may be poly-lysine coated in advance for up to two weeks.

Plate 293T cells (do not carry cells past P+20) at $2\times10^5$ cells/well in 0.5 ml DMEM(Dulbecco's Modified Eagle Medium)(with 4.5 G/L glucose and L-glutamine (12-604F Biowhittaker))/10% heat inactivated FBS(14-503F Biowhittaker)/1×Penstrep(17-602E Biowhittaker). Let the cells grow overnight.

The next day, mix together in a sterile solution basin: 300 ul Lipofectamine (18324-012 Gibco/BRL) and 5 ml Optimem I (31985070 Gibco/BRL)/96-well plate. With a small volume multi-channel pipetter, aliquot approximately 2 ug of an expression vector containing a polynucleotide insert, produced by the methods described in Examples 8 or 9, into an appropriately labeled 96-well round bottom plate. With a multi-channel pipetter, add 50 ul of the Lipofectamine/ Optimem I mixture to each well. Pipette up and down gently to mix. Incubate at RT 15–45 minutes. After about 20 minutes, use a multi-channel pipetter to add 150 ul Optimem I to each well. As a control, one plate of vector DNA lacking an insert should be transfected with each set of transfections.

Preferably, the transfection should be performed by tag-teaming the following tasks. By tag-teaming, hands on time is cut in half, and the cells do not spend too much time on PBS. First, person A aspirates off the media from four 24-well plates of cells, and then person B rinses each well with 0.5–1 ml PBS. Person A then aspirates off PBS rinse, and person B, using a12-channel pipetter with tips on every other channel, adds the 200 ul of DNA/Lipofectamine/ Optimem I complex to the odd wells first, then to the even wells, to each row on the 24-well plates. Incubate at 37° C. for 6 hours.

While cells are incubating, prepare appropriate media, either 1%BSA in DMEM with 1×penstrep, or CHO-5 media (116.6 mg/L of CaCl2 (anhyd); 0.00130 mg/L $CuSO_4$—$5H_2O$; 0.050 mg/L of $Fe(NO_3)_3$—$9H_2O$; 0.417 mg/L of $FeSO_4$—$7H_2O$; 311.80 mg/L of Kcl; 28.64 mg/L of $MgCl_2$; 48.84 mg/L of $MgSO_4$; 6995.50 mg/L of NaCl; 2400.0 mg/L of $NaHCO_3$; 62.50 mg/L of $NaH_2PO_4$—$H_2O$; 71.02 mg/L of $Na_2HPO4$; 0.4320 mg/L of $ZnSO_4$—$7H_2O$; 0.002 mg/L of Arachidonic Acid; 1.022 mg/L of Cholesterol; 0.070 mg/L of DL-alpha-Tocopherol-Acetate; 0.0520 mg/L of Linoleic Acid; 0.010 mg/L of Linolenic Acid; 0.010 mg/L of Myristic Acid; 0.010 mg/L of Oleic Acid; 0.010 mg/L of Palmitric Acid; 0.010 mg/L of Palmitic Acid; 100 mg/L of Pluronic F-68; 0.010 mg/L of Stearic Acid; 2.20 mg/L of Tween 80; 4551 mg/L of D-Glucose; 130.85 mg/ml of L-Alanine; 147.50 mg/ml of L-Arginine-HCL; 7.50 mg/ml of L-Asparagine-$H_2O$; 6.65 mg/ml of L-Aspartic Acid; 29.56 mg/ml of L-Cystine-2HCL-$H_2O$; 31.29 mg/ml of L-Cystine-2HCL; 7.35 mg/ml of L-Glutamic Acid; 365.0 mg/ml of L-Glutamine; 18.75 mg/ml of Glycine; 52.48 mg/ml of L-Histidine-HCL-$H_2O$; 106.97 mg/ml of L-Isoleucine; 111.45 mg/ml of L-Leucine; 163.75 mg/ml of L-Lysine HCL; 32.34 mg/ml of L-Methionine; 68.48 mg/ml of L-Phenylalainine; 40.0 mg/ml of L-Proline; 26.25 mg/ml of L-Serine; 101.05 mg/ml of L-Threonine; 19.22 mg/ml of L-Tryptophan; 91.79 mg/ml of L-Tryrosine-2Na—$2H_2O$; 99.65 mg/ml of L-Valine; 0.0035 mg/L of Biotin; 3.24 mg/L of D—Ca Pantothenate; 11.78 mg/L of Choline Chloride; 4.65 mg/L of Folic Acid; 15.60 mg/L of i-Inositol; 3.02 mg/L of Niacinamide; 3.00 mg/L of Pyridoxal HCL; 0.031 mg/L of Pyridoxine HCL; 0.319 mg/L of Riboflavin; 3.17 mg/L of Thiamine HCL; 0.365 mg/L of Thymidine; and 0.680 mg/L of Vitamin $B_{12}$; 25 mM of HEPES Buffer; 2.39 mg/L of Na Hypoxanthine; 0.105 mg/L of Lipoic Acid; 0.081 mg/L of Sodium Putrescine-2HCL; 55.0 mg/L of Sodium Pyruvate; 0.0067 mg/L of Sodium Selenite; 20 uM of Ethanolamine; 0.122 mg/L of Ferric Citrate; 41.70 mg/L of Methyl-B-Cyclodextrin complexed with Linoleic Acid; 33.33 mg/L of Methyl-B-Cyclodextrin complexed with Oleic Acid; and 10 mg/L of Methyl-B-Cyclodextrin complexed with Retinal) with 2 mm glutamine and 1×penstrep. (BSA (81-068-3 Bayer) 100 gm dissolved in 1L DMEM for a 10% BSA stock solution). Filter the media and collect 50 ul for endotoxin assay in 15 ml polystyrene conical.

The transfection reaction is terminated, preferably by tag-teaming, at the end of the incubation period. Person A aspirates off the transfection media, while person B adds 1.5 ml appropriate media to each well. Incubate at 37° C. for 45 or 72 hours depending on the media used: 1%BSA for 45 hours or CHO-5 for 72 hours.

On day four, using a 300 ul multichannel pipetter, aliquot 600 ul in one 1 ml deep well plate and the remaining supernatant into a 2 ml deep well. The supernatants from each well can then be used in the assays described in Examples 13–20.

It is specifically understood that when activity is obtained in any of the assays described below using a supernatant, the activity originates from either the polypeptide directly (e.g., as a secreted protein) or by the polypeptide inducing expression of other proteins, which are then secreted into the supernatant. Thus, the invention further provides a method of identifying the protein in the supernatant characterized by an activity in a particular assay.

Example 12
Construction of GAS Reporter Construct

One signal transduction pathway involved in the differentiation and proliferation of cells is called the Jaks-STATs pathway. Activated proteins in the Jaks-STATs pathway bind to gamma activation site "GAS" elements or interferon-sensitive responsive element ("ISRE"), located in the promoter of many genes. The binding of a protein to these elements alter the expression of the associated gene.

GAS and ISRE elements are recognized by a class of transcription factors called Signal Transducers and Activators of Transcription, or "STATs." There are six members of the STATs family. Stat1 and Stat3 are present in many cell types, as is Stat2 (as response to IFN-alpha is widespread). Stat4 is more restricted and is not in many cell types though it has been found in T helper class I, cells after treatment with IL-12. Stat5 was originally called mammary growth factor, but has been found at higher concentrations in other cells including myeloid cells. It can be activated in tissue culture cells by many cytokines.

The STATs are activated to translocate from the cytoplasm to the nucleus upon tyrosine phosphorylation by a set of kinases known as the Janus Kinase ("Jaks") family. Jaks represent a distinct family of soluble tyrosine kinases and include Tyk2, Jak1, Jak2, and Jak3. These kinases display significant sequence similarity and are generally catalytically inactive in resting cells.

The Jaks are activated by a wide range of receptors summarized in the Table below. (Adapted from review by Schidler and Darnell, Ann. Rev. Biochem. 64:621–51 (1995).) A cytokine receptor family, capable of activating Jaks, is divided into two groups: (a) Class 1 includes receptors for IL-2, IL-3, IL-4, IL-6, IL-7, IL-9, IL-11, IL-12, IL-15, Epo, PRL, GH, G-CSF, GM-CSF, LIF, CNTF, and thrombopoietin; and (b) Class 2 includes IFN-a, IFN-g, and IL-10. The Class 1 receptors share a conserved cysteine motif (a set of four conserved cysteines and one tryptophan) and a WSXWS motif (a membrane proxial region encoding Trp-Ser-Xxx-Trp-Ser (SEQ ID NO:2)).

Thus, on binding of a ligand to a receptor, Jaks are activated, which in turn activate STATs, which then translocate and bind to GAS elements. This entire process is encompassed in the Jaks-STATs signal transduction pathway.

Therefore, activation of the Jaks-STATs pathway, reflected by the binding of the GAS or the ISRE element, can be used to indicate proteins involved in the proliferation and differentiation of cells. For example, growth factors and cytokines are known to activate the Jaks-STATs pathway. (See Table below.) Thus, by using GAS elements linked to reporter molecules, activators of the Jaks-STATs pathway can be identified.

GATTTCCCCGAAATATCTGCCATCTCAATTAG:3' (SEQ ID NO:3)

The downstream primer is complementary to the SV40 promoter and is flanked with a Hind III site: 5':GCG-GCAAGCTTTTTGCAAAGCCTAGGC:3' (SEQ ID NO:4)

PCR amplification is performed using the SV40 promoter template present in the B-gal:promoter plasmid obtained from Clontech. The resulting PCR fragment is digested with XhoI/Hind III and subcloned into BLSK2-. (Stratagene.) Sequencing with forward and reverse primers confirms that the insert contains the following sequence:

5':<u>CTCGAG</u>ATTTCCCCGAAATCTAGATTTCCCCGA AATGATTTCCCCGAAATGATTTCCCCGAAATAT CTGCCATCTCAATTAGTCAGCAACCAT-

| | JAKs | | | | | |
|---|---|---|---|---|---|---|
| Ligand | tyk2 | Jak1 | Jak2 | Jak3 | STATS | GAS (elements) or ISRE |
| IFN family | | | | | | |
| IFN-a/B | + | + | − | − | 1, 2, 3 | ISRE |
| IFN-g | | + | + | − | 1 | GAS (IRF1 > Lys6 > IFP) |
| Il-10 | + | ? | ? | − | 1, 3 | |
| gp130 family | | | | | | |
| IL-6 (Pleiotrohic) | + | + | + | ? | 1, 3 | GAS (IRF1 > Lys6 > IFP) |
| Il-11 (Pleiotrohic) | ? | + | ? | ? | 1, 3 | |
| OnM (Pleiotrohic) | ? | + | + | ? | 1, 3 | |
| LIF (Pleiotrohic) | ? | + | + | ? | 1, 3 | |
| CNTF (Pleiotrohic) | −/+ | + | + | ? | 1, 3 | |
| G-CSF (Pleiotrohic) | ? | + | ? | ? | 1, 3 | |
| IL-12 (Pleiotrohic) | + | − | + | + | 1, 3 | |
| g-C family | | | | | | |
| IL-2 (lymphocytes) | − | + | − | + | 1, 3, 5 | GAS |
| IL-4 (lymph/myeloid) | − | + | − | + | 6 | GAS (IRF1 = IFP >>Ly6)(IgH) |
| IL-7 (lymphocytes) | − | + | − | + | 5 | GAS |
| IL-9 (lymphocytes) | − | + | − | + | 5 | GAS |
| IL-13 (lymphocyte) | − | + | ? | ? | 6 | GAS |
| IL-15 | ? | + | ? | + | 5 | GAS |
| gp140 family | | | | | | |
| IL-3 (myeloid) | − | − | + | − | 5 | GAS (IRF1 > IFP >> Ly6) |
| IL-5 (myeloid) | − | − | + | − | 5 | GAS |
| GM-CSF (myeloid) | − | − | + | − | 5 | GAS |
| Growth hormone family | | | | | | |
| GH | ? | − | + | − | 5 | |
| PRL | ? | +/− | + | − | 1, 3, 5 | |
| EPO | ? | − | + | − | 5 | GAS (B − CAS > IRF1 = IFP >>Ly6) |
| Receptor Tyrosine Kinases | | | | | | |
| EGF | ? | + | + | − | 1, 3 | GAS (IRF1) |
| PDGF | ? | + | + | − | 1, 3 | |
| CSF-1 | ? | + | + | − | 1, 3 | GAS (not IRF1) |

To construct a synthetic GAS containing promoter element, which is used in the Biological Assays described in Examples 13–14, a PCR based strategy is employed to generate a GAS-SV40 promoter sequence. The 5' primer contains four tandem copies of the GAS binding site found in the IRF1 promoter and previously demonstrated to bind STATs upon induction with a range of cytokines (Rothman et al., Immunity 1:457–468 (1994).), although other GAS or ISRE elements can be used instead. The 5' primer also contains 18 bp of sequence complementary to the SV40 early promoter sequence and is flanked with an XhoI site. The sequence of the 5' primer is:

5':GCGCCTCGAGATTTCCCCGAAATCTA- GATTTCCCCGAAATGATTTCCCCGAAAT- AGTCCCGCCCCTAACTCCGCCCATC- CCGCCCCTAACTCCGCCCAGTTCCGC- CCATTCTCCGCCCCATGGCTGACTAATYTTTTTT ATTTATGCAGAGGCCGAGGCCGCCTCGGCCTCTG AGCTATTCCAGAAGTAGTGAGGAGGCTTTTTTGG AGGCCTAGGCTTTTGCAAA<u>AAGCTT</u>:3' (SEQ ID NO:5)

With this GAS promoter element linked to the SV40 promoter, a GAS:SEAP2 reporter construct is next engineered. Here, the reporter molecule is a secreted alkaline phosphatase, or "SEAP." Clearly, however, any reporter molecule can be instead of SEAP, in this or in any of the other Examples. Well known reporter molecules that can be used instead of SEAP include chloramphenicol acetyltransferase (CAT), luciferase, alkaline phosphatase, B-galactosidase, green fluorescent protein (GFP), or any protein detectable by an antibody.

The above sequence confirmed synthetic GAS-SV40 promoter element is subcloned into the pSEAP-Promoter vector obtained from Clontech using HindIII and XhoI, effectively replacing the SV40 promoter with the amplified GAS:SV40 promoter element, to create the GAS-SEAP vector. However, this vector does not contain a neomycin resistance gene, and therefore, is not preferred for mammalian expression systems.

Thus, in order to generate mammalian stable cell lines expressing the GAS-SEAP reporter, the GAS-SEAP cassette is removed from the GAS-SEAP vector using SalI and NotI, and inserted into a backbone vector containing the neomycin resistance gene, such as pGFP-1 (Clontech), using these restriction sites in the multiple cloning site, to create the GAS-SEAP/Neo vector. Once this vector is transfected into mammalian cells, this vector can then be used as a reporter molecule for GAS binding as described in Examples 13–14.

Other constructs can be made using the above description and replacing GAS with a different promoter sequence. For example, construction of reporter molecules containing NFK-B and EGR promoter sequences are described in Examples 15 and 16. However, many other promoters can be substituted using the protocols described in these Examples. For instance, SRE, IL-2, NFAT, or Osteocalcin promoters can be substituted, alone or in combination (e.g., GAS/NF-KB/EGR, GAS/NF-KB, I1-2/NFAT, or NF-KB/GAS). Similarly, other cell lines can be used to test reporter construct activity, such as HELA (epithelial), HUVEC (endothelial), Reh (B-cell), Saos-2 (osteoblast), HUVAC (aortic), or Cardiomyocyte.

Example 13
High-Throughput Screening Assay for T-cell Activity

The following protocol is used to assess T-cell activity by identifying factors, such as growth factors and cytokines, that may proliferate or differentiate T-cells. T-cell activity is assessed using the GAS/SEAP/Neo construct produced in Example 12. Thus, factors that increase SEAP activity indicate the ability to activate the Jaks-STATS signal transduction pathway. The T-cell used in this assay is Jurkat T-cells (ATCC Accession No. TIB-152), although Molt-3 cells (ATCC Accession No. CRL-1552) and Molt-4 cells (ATCC Accession No. CRL-1582) cells can also be used.

Jurkat T-cells are lymphoblastic CD4+ Th1 helper cells. In order to generate stable cell lines, approximately 2 million Jurkat cells are transfected with the GAS-SEAP/neo vector using DMRIE-C (Life Technologies)(transfection procedure described below). The transfected cells are seeded to a density of approximately 20,000 cells per well and transfectants resistant to 1 mg/ml genticin selected. Resistant colonies are expanded and then tested for their response to increasing concentrations of interferon gamma. The dose response of a selected clone is demonstrated.

Specifically, the following protocol will yield sufficient cells for 75 wells containing 200 ul of cells. Thus, it is either scaled up, or performed in multiple to generate sufficient cells for multiple 96 well plates. Jurkat cells are maintained in RPMI+10% serum with 1% Pen-Strep. Combine 2.5 mls of OPTI-MEM (Life Technologies) with 10 ug of plasmid DNA in a T25 flask. Add 2.5 ml OPTI-MEM containing 50 ul of DMRIE-C and incubate at room temperature for 15–45 mins.

During the incubation period, count cell concentration, spin down the required number of cells ($10^7$ per transfection), and resuspend in OPTI-MEM to a final concentration of $10^7$ cells/ml. Then add 1 ml of $1\times10^7$ cells in OPTI-MEM to T25 flask and incubate at 37° C. for 6 hrs. After the incubation, add 10 ml of RPMI+15% serum.

The Jurkat:GAS-SEAP stable reporter lines are maintained in RPMI+10% serum, 1 mg/ml Genticin, and 1% Pen-Strep. These cells are treated with supernatants containing a polypeptide as produced by the protocol described in Example 11.

On the day of treatment with the supernatant, the cells should be washed and resuspended in fresh RPMI+10% serum to a density of 500,000 cells per ml. The exact number of cells required will depend on the number of supernatants being screened. For one 96 well plate, approximately 10 million cells (for 10 plates, 100 million cells) are required.

Transfer the cells to a triangular reservoir boat, in order to dispense the cells into a 96 well dish, using a 12 channel pipette. Using a 12 channel pipette, transfer 200 ul of cells into each well (therefore adding 100, 000 cells per well).

After all the plates have been seeded, 50 ul of the supernatants are transferred directly from the 96 well plate containing the supernatants into each well using a 12 channel pipette. In addition, a dose of exogenous interferon gamma (0.1, 1.0, 10 ng) is added to wells H9, H10, and H11 to serve as additional positive controls for the assay.

The 96 well dishes containing Jurkat cells treated with supernatants are placed in an incubator for 48 hrs (note: this time is variable between 48–72 hrs). 35 ul samples from each well are then transferred to an opaque 96 well plate using a 12 channel pipette. The opaque plates should be covered (using sellophene covers) and stored at −20° C. until SEAP assays are performed according to Example 17. The plates containing the remaining treated cells are placed at 4° C. and serve as a source of material for repeating the assay on a specific well if desired.

As a positive control, 100 Unit/ml interferon gamma can be used which is known to activate Jurkat T cells. Over 30 fold induction is typically observed in the positive control wells.

Example 14
High-Throughput Screening Assay Identifying Myeloid Activity

The following protocol is used to assess myeloid activity by identifying factors, such as growth factors and cytokines, that may proliferate or differentiate myeloid cells. Myeloid cell activity is assessed using the GAS/SEAP/Neo construct produced in Example 12. Thus, factors that increase SEAP activity indicate the ability to activate the Jaks-STATS signal transduction pathway. The myeloid cell used in this assay is U937, a pre-monocyte cell line, although TF-1, HL60, or KG1 can be used.

To transiently transfect U937 cells with the GAS/SEAP/Neo construct produced in Example 12, a DEAE-Dextran method (Kharbanda et. al., 1994, Cell Growth & Differentiation, 5:259–265) is used. First, harvest $2\times10e^7$ U937 cells and wash with PBS. The U937 cells are usually grown in RPMI 1640 medium containing 10% heat-inactivated fetal bovine serum (FBS) supplemented with 100 units/ml penicillin and 100 mg/ml streptomycin.

Next, suspend the cells in 1 ml of 20 mM Tris-HCl (pH 7.4) buffer containing 0.5 mg/ml DEAE-Dextran, 8 ug GAS-SEAP2 plasmid DNA, 140 mM NaCl, 5 mM KCl, 375 uM $Na_2HPO_4 \cdot 7H_2O$, 1 mM $MgCl_2$, and 675 uM $CaCl_2$. Incubate at 37° C. for 45 min.

Wash the cells with RPMI 1640 medium containing 10% FBS and then resuspend in 10 ml complete medium and incubate at 37° C. for 36 hr.

The GAS-SEAP/U937 stable cells are obtained by growing the cells in 400 ug/ml G418. The G418-free medium is used for routine growth but every one to two months, the cells should be re-grown in 400 ug/ml G418 for couple of passages.

These cells are tested by harvesting $1 \times 10^8$ cells (this is enough for ten 96-well plates assay) and wash with PBS. Suspend the cells in 200 ml above described growth medium, with a final density of $5 \times 10^5$ cells/ml. Plate 200 ul cells per well in the 96-well plate (or $1 \times 10^5$ cells/well).

Add 50 ul of the supernatant prepared by the protocol described in Example 11. Incubate at 37° C. for 48 to 72 hr. As a positive control, 100 Unit/ml interferon gamma can be used which is known to activate U937 cells. Over 30 fold induction is typically observed in the positive control wells. SEAP assay the supernatant according to the protocol described in Example 17.

Example 15
High-Throughput Screening Assay Identifying Neuronal Activity

When cells undergo differentiation and proliferation, a group of genes are activated through many different signal transduction pathways. One of these genes, EGR1 (early growth response gene 1), is induced in various tissues and cell types upon activation. The promoter of EGR1 is responsible for such induction. Using the EGR1 promoter linked to reporter molecules, activation of cells can be assessed.

Particularly, the following protocol is used to assess neuronal activity in PC12 cell lines. PC12 cells (rat phenochromocytoma cells) are known to proliferate and/or differentiate by activation with a number of mitogens, such as TPA (tetradecanoyl phorbol acetate), NGF (nerve growth factor), and EGF (epidermal growth factor). The EGR1 gene expression is activated during this treatment. Thus, by stably transfecting PC12 cells with a construct containing an EGR promoter linked to SEAP reporter, activation of PC12 cells can be assessed.

The EGR/SEAP reporter construct can be assembled by the following protocol. The EGR-1 promoter sequence (−633 to +1)(Sakamoto K et al., Oncogene 6:867–871 (1991)) can be PCR amplified from human genomic DNA using the following primers:

5' GCGCTCGAGGGATGACAGCGATAGAACCC CGG-3' (SEQ ID NO:6)

5' GCGAAGCTTCGCGACTCCCCGGATCCGCCTC-3' (SEQ ID NO:7)

Using the GAS:SEAP/Neo vector produced in Example 12, EGR1 amplified product can then be inserted into this vector. Linearize the GAS:SEAP/Neo vector using restriction enzymes XhoI/HindIII, removing the GAS/SV40 stuffer. Restrict the EGR1 amplified product with these same enzymes. Ligate the vector and the EGR1 promoter.

To prepare 96 well-plates for cell culture, two mls of a coating solution (1:30 dilution of collagen type I (Upstate Biotech Inc. Cat#08-115) in 30% ethanol (filter sterilized)) is added per one 10 cm plate or 50 ml per well of the 96-well plate, and allowed to air dry for 2 hr.

PC12 cells are routinely grown in RPMI-1640 medium (Bio Whittaker) containing 10% horse serum (JRH BIOSCIENCES, Cat. # 12449-78P), 5% heat-inactivated fetal bovine serum (FBS) supplemented with 100 units/ml penicillin and 100 ug/ml streptomycin on a precoated 10 cm tissue culture dish. One to four split is done every three to four days. Cells are removed from the plates by scraping and resuspended with pipetting up and down for more than 15 times.

Transfect the EGR/SEAP/Neo construct into PC12 using the Lipofectamine protocol described in Example 11. EGR-SEAP/PC12 stable cells are obtained by growing the cells in 300 ug/ml G418. The G418-free medium is used for routine growth but every one to two months, the cells should be re-grown in 300 ug/ml G418 for couple of passages.

To assay for neuronal activity, a 10 cm plate with cells around 70 to 80% confluent is screened by removing the old medium. Wash the cells once with PBS (Phosphate buffered saline). Then starve the cells in low serum medium (RPMI-1640 containing 1% horse serum and 0.5% FBS with antibiotics) overnight.

The next morning, remove the medium and wash the cells with PBS. Scrape off the cells from the plate, suspend the cells well in 2 ml low serum medium. Count the cell number and add more low serum medium to reach final cell density as $5 \times 10^5$ cells/ml.

Add 200 ul of the cell suspension to each well of 96-well plate (equivalent to $1 \times 10^5$ cells/well). Add 50 ul supernatant produced by Example 11, 37° C. for 48 to 72 hr. As a positive control, a growth factor known to activate PC12 cells through EGR can be used, such as 50 ng/ul of Neuronal Growth Factor (NGF). Over fifty-fold induction of SEAP is typically seen in the positive control wells. SEAP assay the supernatant according to Example 17.

Example 16
High-Throughput Screening Assay for T-cell Activity

NF-κB (Nuclear Factor κB) is a transcription factor activated by a wide variety of agents including the inflammatory cytokines IL-1 and TNF, CD30 and CD40, lymphotoxin-alpha and lymphotoxin-beta, by exposure to LPS or thrombin, and by expression of certain viral gene products. As a transcription factor, NF-κB regulates the expression of genes involved in immune cell activation, control of apoptosis (NF-κB appears to shield cells from apoptosis), B and T-cell development, anti-viral and antimicrobial responses, and multiple stress responses.

In non-stimulated conditions, NF-κB is retained in the cytoplasm with I-κB (Inhibitor κB). However, upon stimulation, I-κB is phosphorylated and degraded, causing NF-κB to shuttle to the nucleus, thereby activating transcription of target genes. Target genes activated by NF-κB include IL-2, IL-6, GM-CSF, ICAM-1 and class 1 MHC.

Due to its central role and ability to respond to a range of stimuli, reporter constructs utilizing the NF-κB promoter element are used to screen the supernatants produced in Example 11. Activators or inhibitors of NF-κB would be useful in treating diseases. For example, inhibitors of NF-κB could be used to treat those diseases related to the acute or chronic activation of NF-kB, such as rheumatoid arthritis.

To construct a vector containing the NF-κB promoter element, a PCR based strategy is employed. The upstream primer contains four tandem copies of the NF-κB binding site (GGGGACTTTCCC) (SEQ ID NO:8), 18 bp of sequence complementary to the 5' end of the SV40 early promoter sequence, and is flanked with an XhoI site:
5':GCGGCCTCGAGGGGACTTTCCCGGG-
   GACTTTCCGGGGACTTTCCGGGACTTTC-
   CATCCTGCCATCTCAATTAG:3' (SEQ ID NO:9)

The downstream primer is complementary to the 3' end of the SV40 promoter and is flanked with a Hind III site:
5':GCGGCAAGCTTTTTGCAAAGCCTAGGC:3' (SEQ ID NO:4)

PCR amplification is performed using the SV40 promoter template present in the pB-gal:promoter plasmid obtained from Clontech. The resulting PCR fragment is digested with XhoI and Hind III and subcloned into BLSK2-. (Stratagene) Sequencing with the T7 and T3 primers confirms the insert contains the following sequence:
5':CTCGAGGGGACTTTCCCGGGGACTTTC-
   CGGGGACTTTCCGGGACTTTCCATCTGC-
   CATCTCAATTAGTCAGCAACCATAGTC-
   CCGCCCCTAACTCCGCCCATCCCGCCCCTAACT
   CCGCCCAGTTCCGCCCATTCTCCGCCCCATGGC
   TGACTAATTTTTTTATTTATGCAGAGGCCGAG
   GCCGCCTCGGCCTCTGAGCTATTCCAGAAGTAG
   TGAGGAGGCTTTTTGGAGGCCTAGGCTTTTGCA
   AAAAGCTT:3' (SEQ ID NO:10)

Next, replace the SV40 minimal promoter element present in the pSEAP2-promoter plasmid (Clontech) with this NF-κB/SV40 fragment using XhoI and HindIII. However, this vector does not contain a neomycin resistance gene, and therefore, is not preferred for mammalian expression systems.

In order to generate stable mammalian cell lines, the NF-κB/SV40/SEAP cassette is removed from the above NF-κB/SEAP vector using restriction enzymes SalI and NotI, and inserted into a vector containing neomycin resistance. Particularly, the NF-κB/SV40/SEAP cassette was inserted into pGFP-1 (Clontech), replacing the GFP gene, after restricting pGFP-1 with SalI and NotI.

Once NF-κB/SV40/SEAP/Neo vector is created, stable Jurkat T-cells are created and maintained according to the protocol described in Example 13. Similarly, the method for assaying supernatants with these stable Jurkat T-cells is also described in Example 13. As a positive control, exogenous TNF alpha (0.1,1, 10 ng) is added to wells H9, H10, and H11, with a 5–10 fold activation typically observed.

Example 17
Assay for SEAP Activity

As a reporter molecule for the assays described in Examples 13–16, SEAP activity is assayed using the Tropix Phospho-light Kit (Cat. BP-400) according to the following general procedure. The Tropix Phospho-light Kit supplies the Dilution, Assay, and Reaction Buffers used below.

Prime a dispenser with the 2.5×Dilution Buffer and dispense 15 μl of 2.5×dilution buffer into Optiplates containing 35 μl of a supernatant. Seal the plates with a plastic sealer and incubate at 65° C. for 30 min. Separate the Optiplates to avoid uneven heating.

Cool the samples to room temperature for 15 minutes. Empty the dispenser and prime with the Assay Buffer. Add 50 μl Assay Buffer and incubate at room temperature 5 min. Empty the dispenser and prime with the Reaction Buffer (see the table below). Add 50 μl Reaction Buffer and incubate at room temperature for 20 minutes. Since the intensity of the chemiluminescent signal is time dependent, and it takes about 10 minutes to read 5 plates on luminometer, one should treat 5 plates at each time and start the second set 10 minutes later.

Read the relative light unit in the luminometer. Set H12 as blank, and print the results. An increase in chemiluminescence indicates reporter activity.

| Reaction Buffer Formulation: | | |
|---|---|---|
| # of plates | Rxn buffer diluent (ml) | CSPD (ml) |
| 10 | 60 | 3 |
| 11 | 65 | 3.25 |
| 12 | 70 | 3.5 |
| 13 | 75 | 3.75 |
| 14 | 80 | 4 |
| 15 | 85 | 4.25 |
| 16 | 90 | 4.5 |
| 17 | 95 | 4.75 |
| 18 | 100 | 5 |
| 19 | 105 | 5.25 |
| 20 | 110 | 5.5 |
| 21 | 115 | 5.75 |
| 22 | 120 | 6 |
| 23 | 125 | 6.25 |
| 24 | 130 | 6.5 |
| 25 | 135 | 6.75 |
| 26 | 140 | 7 |
| 27 | 145 | 7.25 |
| 28 | 150 | 7.5 |
| 29 | 155 | 7.75 |
| 30 | 160 | 8 |
| 31 | 165 | 8.25 |
| 32 | 170 | 8.5 |
| 33 | 175 | 8.75 |
| 34 | 180 | 9 |
| 35 | 185 | 9.25 |
| 36 | 190 | 9.5 |
| 37 | 195 | 9.75 |
| 38 | 200 | 10 |
| 39 | 205 | 10.25 |
| 40 | 210 | 10.5 |
| 41 | 215 | 10.75 |
| 42 | 220 | 11 |
| 43 | 225 | 11.25 |
| 44 | 230 | 11.5 |
| 45 | 235 | 11.75 |
| 46 | 240 | 12 |
| 47 | 245 | 12.25 |
| 48 | 250 | 12.5 |
| 49 | 255 | 12.75 |
| 50 | 260 | 13 |

Example 18
High-Throughput Screening Assay Identifying Changes in Small Molecule Concentration and Membrane Permeability Binding of a ligand to a receptor is known to alter intracellular levels of small molecules, such as calcium, potassium, sodium, and pH, as well as alter membrane potential. These alterations can be measured in an assay to identify supernatants which bind to receptors of a particular cell. Although the following protocol describes an assay for calcium, this protocol can easily be modified to detect changes in potassium, sodium, pH, membrane potential, or any other small molecule which is detectable by a fluorescent probe.

The following assay uses Fluorometric Imaging Plate Reader ("FLIPR") to measure changes in fluorescent molecules (Molecular Probes) that bind small molecules. Clearly, any fluorescent molecule detecting a small molecule can be used instead of the calcium fluorescent molecule, fluo-3, used here.

For adherent cells, seed the cells at 10,000–20,000 cells/well in a Co-star black 96-well plate with clear bottom. The plate is incubated in a $CO_2$ incubator for 20 hours. The adherent cells are washed two times in Biotek washer with 200 ul of HBSS (Hank's Balanced Salt Solution) leaving 100 ul of buffer after the final wash.

A stock solution of 1 mg/ml fluo-3 is made in 10% pluronic acid DMSO. To load the cells with fluo-3, 50 ul of 12 ug/ml fluo-3 is added to each well. The plate is incubated at 37° C. in a $CO_2$ incubator for 60 min. The plate is washed four times in the Biotek washer with HBSS leaving 100 ul of buffer.

For non-adherent cells, the cells are spun down from culture media. Cells are re-suspended to $2–5\times10^6$ cells/ml with HBSS in a 50-ml conical tube. 4 ul of 1 mg/ml fluo-3 solution in 10% pluronic acid DMSO is added to each ml of cell suspension. The tube is then placed in a 37° C. water bath for 30–60 min. The cells are washed twice with HBSS, resuspended to $1\times10^6$ cells/ml, and dispensed into a microplate, 100 ul/well. The plate is centrifuged at 1000 rpm for 5 min. The plate is then washed once in Denley CellWash with 200 ul, followed by an aspiration step to 100 ul final volume.

For a non-cell based assay, each well contains a fluorescent molecule, such as fluo-3. The supernatant is added to the well, and a change in fluorescence is detected.

To measure the fluorescence of intracellular calcium, the FLIPR is set for the following parameters: (1) System gain is 300–800 mW; (2) Exposure time is 0.4 second; (3) Camera F/stop is F/2; (4) Excitation is 488 nm; (5) Emission is 530 nm; and (6) Sample addition is 50 ul. Increased emission at 530 nm indicates an extracellular signaling event which has resulted in an increase in the intracellular Ca++ concentration.

Example 19
High-Throughput Screening Assay Identifying Tyrosine Kinase Activity

The Protein Tyrosine Kinases (PTK) represent a diverse group of transmembrane and cytoplasmic kinases. Within the Receptor Protein Tyrosine Kinase RPTK group are receptors for a range of mitogenic and metabolic growth factors including the PDGF, FGF, EGF, NGF, HGF and Insulin receptor subfamilies. In addition there are a large family of RPTKs for which the corresponding ligand is unknown. Ligands for RPTKs include mainly secreted small proteins, but also membrane-bound and extracellular matrix proteins.

Activation of RPTK by ligands involves ligand-mediated receptor dimerization, resulting in transphosphorylation of the receptor subunits and activation of the cytoplasmic tyrosine kinases. The cytoplasmic tyrosine kinases include receptor associated tyrosine kinases of the src-family (e.g., src, yes, lck, lyn, fyn) and non-receptor linked and cytosolic protein tyrosine kinases, such as the Jak family, members of which mediate signal transduction triggered by the cytokine superfamily of receptors (e.g., the Interleukins, Interferons, GM-CSF, and Leptin).

Because of the wide range of known factors capable of stimulating tyrosine kinase activity, the identification of novel human secreted proteins capable of activating tyrosine kinase signal transduction pathways are of interest. Therefore, the following protocol is designed to identify those novel human secreted proteins capable of activating the tyrosine kinase signal transduction pathways.

Seed target cells (e.g., primary keratinocytes) at a density of approximately 25,000 cells per well in a 96 well Loprodyne Silent Screen Plates purchased from Nalge Nunc (Naperville, Ill.). The plates are sterilized with two 30 minute rinses with 100% ethanol, rinsed with water and dried overnight. Some plates are coated for 2 hr with 100 ml of cell culture grade type I collagen (50 mg/ml), gelatin (2%) or polylysine (50 mg//ml), all of which can be purchased from Sigma Chemicals (St. Louis, Mo.) or 10% Matrigel purchased from Becton Dickinson (Bedford, Mass., or calf serum, rinsed with PBS and stored at 4° C. Cell growth on these plates is assayed by seeding 5,000 cells/well in growth medium and indirect quantitation of cell number through use of alamarBlue as described by the manufacturer Alamar Biosciences, Inc. (Sacramento, Calif.) after 48 hr. Falcon plate covers #3071 from Becton Dickinson (Bedford, Mass.) are used to cover the Loprodyne Silent Screen Plates. Falcon Microtest III cell culture plates can also be used in some proliferation experiments.

To prepare extracts, A431 cells are seeded onto the nylon membranes of Loprodyne plates (20,000/200 ml/well) and cultured overnight in complete medium. Cells are quiesced by incubation in serum-free basal medium for 24 hr. After 5–20 minutes treatment with EGF (60 ng/ml) or 50 ul of the supernatant produced in Example 11, the medium was removed and 100 ml of extraction buffer ((20 mM HEPES pH 7.5, 0.15 M NaCl, 1% Triton X-100, 0.1% SDS, 2 mM Na3VO4, 2 mM Na4P207 and a cocktail of protease inhibitors (# 1836170) obtained from Boeheringer Mannheim (Indianapolis, Ind.) is added to each well and the plate is shaken on a rotating shaker for 5 minutes at 4° C. The plate is then placed in a vacuum transfer manifold and the extract filtered through the 0.45 mm membrane bottoms of each well using house vacuum. Extracts are collected in a 96-well catch/assay plate in the bottom of the vacuum manifold and immediately placed on ice. To obtain extracts clarified by centrifugation, the content of each well, after detergent solubilization for 5 minutes, is removed and centrifuged for 15 minutes at 4° C. at 16,000×g.

Test the filtered extracts for levels of tyrosine kinase activity. Although many methods of detecting tyrosine kinase activity are known, one method is described here.

Generally, the tyrosine kinase activity of a supernatant is evaluated by determining its ability to phosphorylate a tyrosine residue on a specific substrate (a biotinylated peptide). Biotinylated peptides that can be used for this purpose include PSK1 (corresponding to amino acids 6–20 of the cell division kinase cdc2-p34) and PSK2 (corresponding to amino acids 1–17 of gastrin). Both peptides are substrates for a range of tyrosine kinases and are available from Boehringer Mannheim.

The tyrosine kinase reaction is set up by adding the following components in order. First, add 10 ul of 5 uM Biotinylated Peptide, then 10 ul ATP/$Mg_{2+}$ (5 mM ATP/50 mM $MgCl_2$), then 1oul of 5×Assay Buffer (40 mM imidazole hydrochloride, pH7.3, 40 mM beta-glycerophosphate, 1 mM EGTA, 100 mM $MgCl_2$, 5 mM $MnCl_2$, 0.5 mg/ml BSA), then 5 ul of Sodium Vanadate(1 mM), and then 5 ul of water.

Mix the components gently and preincubate the reaction mix at 30° C. for 2 min. Initial the reaction by adding 10 ul of the control enzyme or the filtered supernatant.

The tyrosine kinase assay reaction is then terminated by adding 10 ul of 120 mm EDTA and place the reactions on ice.

Tyrosine kinase activity is determined by transferring 50 ul aliquot of reaction mixture to a microtiter plate (MTP) module and incubating at 37° C. for 20 min. This allows the streptavadin coated 96 well plate to associate with the biotinylated peptide. Wash the MTP module with 300 ul/well of PBS four times. Next add 75 ul of anti-phospotyrosine antibody conjugated to horse radish peroxidase(anti-P-Tyr-POD(0.5 u/ml)) to each well and incubate at 37° C. for one hour. Wash the well as above.

Next add 100 ul of peroxidase substrate solution (Boehringer Mannheim) and incubate at room temperature for at least 5 mins (up to 30 min). Measure the absorbance of the sample at 405 nm by using ELISA reader. The level of bound peroxidase activity is quantitated using an ELISA reader and reflects the level of tyrosine kinase activity.

Example 20
High-Throughput Screening Assay Identifying Phosphorylation Activity

As a potential alternative and/or compliment to the assay of protein tyrosine kinase activity described in Example 19, an assay which detects activation (phosphorylation) of major intracellular signal transduction intermediates can also be used. For example, as described below one particular assay can detect tyrosine phosphorylation of the Erk-1 and Erk-2 kinases. However, phosphorylation of other molecules, such as Raf, JNK, p38 MAP, Map kinase kinase (MEK), MEK kinase, Src, Muscle specific kinase (MuSK), IRAK, Tec, and Janus, as well as any other phosphoserine, phosphotyrosine, or phosphothreonine molecule, can be detected by substituting these molecules for Erk-1 or Erk-2 in the following assay.

Specifically, assay plates are made by coating the wells of a 96-well ELISA plate with 0.1 ml of protein G (1 ug/ml) for 2 hr at room temp, (RT). The plates are then rinsed with PBS and blocked with 3% BSA/PBS for 1 hr at RT. The protein G plates are then treated with 2 commercial monoclonal antibodies (100 ng/well) against Erk-1 and Erk-2 (1 hr at RT) (Santa Cruz Biotechnology). (To detect other molecules, this step can easily be modified by substituting a monoclonal antibody detecting any of the above described molecules.) After 3–5 rinses with PBS, the plates are stored at 4° C. until use.

A431 cells are seeded at 20,000/well in a 96-well Loprodyne filterplate and cultured overnight in growth medium. The cells are then starved for 48 hr in basal medium (DMEM) and then treated with EGF (6 ng/well) or 50 ul of the supernatants obtained in Example 11 for 5–20 minutes. The cells are then solubilized and extracts filtered directly into the assay plate.

After incubation with the extract for 1 hr at RT, the wells are again rinsed. As a positive control, a commercial preparation of MAP kinase (10 ng/well) is used in place of A431 extract. Plates are then treated with a commercial polyclonal (rabbit) antibody (1 ug/ml) which specifically recognizes the phosphorylated epitope of the Erk-1 and Erk-2 kinases (1 hr at RT). This antibody is biotinylated by standard procedures. The bound polyclonal antibody is then quantitated by successive incubations with Europium-streptavidin and Europium fluorescence enhancing reagent in the Wallac DELFIA instrument (time-resolved fluorescence). An increased fluorescent signal over background indicates a phosphorylation.

Example 21
Method of Determining Alterations in a Gene Corresponding to a Polynucleotide RNA isolated from entire families or individual patients presenting with a phenotype of interest (such as a disease) is be isolated. cDNA is then generated from these RNA samples using protocols known in the art. (See, Sambrook.) The cDNA is then used as a template for PCR, employing primers surrounding regions of interest in SEQ ID NO:X. Suggested PCR conditions consist of 35 cycles at 95° C. for 30 seconds; 60–120 seconds at 52–58° C. ; and 60–120 seconds at 70° C., using buffer solutions described in Sidransky, D., et al., Science 252:706 (1991).

PCR products are then sequenced using primers labeled at their 5' end with T4 polynucleotide kinase, employing SequiTherm Polymerase. (Epicentre Technologies). The intron-exon borders of selected exons is also determined and genomic PCR products analyzed to confirm the results. PCR products harboring suspected mutations is then cloned and sequenced to validate the results of the direct sequencing.

PCR products is cloned into T-tailed vectors as described in Holton, T. A. and Graham, M. W., Nucleic Acids Research, 19:1156 (1991) and sequenced with T7 polymerase (United States Biochemical). Affected individuals are identified by mutations not present in unaffected individuals.

Genomic rearrangements are also observed as a method of determining alterations in a gene corresponding to a polynucleotide. Genomic clones isolated according to Example 2 are nick-translated with digoxigenindeoxy-uridine 5'-triphosphate (Boehringer Manheim), and FISH performed as described in Johnson, Cg. et al., Methods Cell Biol. 35:73–99 (1991). Hybridization with the labeled probe is carried out using a vast excess of human cot-1 DNA for specific hybridization to the corresponding genomic locus.

Chromosomes are counterstained with 4,6-diamino-2-phenylidole and propidium iodide, producing a combination of C- and R-bands. Aligned images for precise mapping are obtained using a triple-band filter set (Chroma Technology, Brattleboro, Vt.) in combination with a cooled charge-coupled device camera (Photometrics, Tucson, Ariz.) and variable excitation wavelength filters. (Johnson, Cv. et al., Genet. Anal. Tech. Appl., 8:75 (1991).) Image collection, analysis and chromosomal fractional length measurements are performed using the ISee Graphical Program System. (Inovision Corporation, Durham, N.C.) Chromosome alterations of the genomic region hybridized by the probe are identified as insertions, deletions, and translocations. These alterations are used as a diagnostic marker for an associated disease.

Example 22
Method of Detecting Abnormal Levels of a Polypeptide in a Biological Sample A polypeptide of the present invention can be detected in a biological sample, and if an increased or decreased level of the polypeptide is detected, this polypeptide is a marker for a particular phenotype. Methods of detection are numerous, and thus, it is understood that one skilled in the art can modify the following assay to fit their particular needs.

For example, antibody-sandwich ELISAs are used to detect polypeptides in a sample, preferably a biological sample. Wells of a microtiter plate are coated with specific antibodies, at a final concentration of 0.2 to 10 ug/ml. The antibodies are either monoclonal or polyclonal and are produced by the method described in Example 10. The wells are blocked so that non-specific binding of the polypeptide to the well is reduced.

The coated wells are then incubated for >2 hours at RT with a sample containing the polypeptide. Preferably, serial dilutions of the sample should be used to validate results. The plates are then washed three times with deionized or distilled water to remove unbounded polypeptide.

Next, 50 ul of specific antibody-alkaline phosphatase conjugate, at a concentration of 25–400 ng, is added and incubated for 2 hours at room temperature. The plates are again washed three times with deionized or distilled water to remove unbounded conjugate.

Add 75 ul of 4-methylumbelliferyl phosphate (MUP) or p-nitrophenyl phosphate (NPP) substrate solution to each well and incubate 1 hour at room temperature. Measure the reaction by a microtiter plate reader. Prepare a standard curve, using serial dilutions of a control sample, and plot polypeptide concentration on the X-axis (log scale) and fluorescence or absorbance of the Y-axis (linear scale). Interpolate the concentration of the polypeptide in the sample using the standard curve.

Example 23

Formulating a Polypeptide

The secreted polypeptide composition will be formulated and dosed in a fashion consistent with good medical practice, taking into account the clinical condition of the individual patient (especially the side effects of treatment with the secreted polypeptide alone), the site of delivery, the method of administration, the scheduling of administration, and other factors known to practitioners. The "effective amount" for purposes herein is thus determined by such considerations.

As a general proposition, the total pharmaceutically effective amount of secreted polypeptide administered parenterally per dose will be in the range of about 1 $\mu$g/kg/day to 10 mg/kg/day of patient body weight, although, as noted above, this will be subject to therapeutic discretion. More preferably, this dose is at least 0.01 mg/kg/day, and most preferably for humans between about 0.01 and 1 mg/kg/day for the hormone. If given continuously, the secreted polypeptide is typically administered at a dose rate of about 1 $\mu$g/kg/hour to about 50 $\mu$g/kg/hour, either by 1–4 injections per day or by continuous subcutaneous infusions, for example, using a mini-pump. An intravenous bag solution may also be employed. The length of treatment needed to observe changes and the interval following treatment for responses to occur appears to vary depending on the desired effect.

Pharmaceutical compositions containing the secreted protein of the invention are administered orally, rectally, parenterally, intracistemally, intravaginally, intraperitoneally, topically (as by powders, ointments, gels, drops or transdermal patch), bucally, or as an oral or nasal spray. "Pharmaceutically acceptable carrier" refers to a non-toxic solid, semisolid or liquid filler, diluent, encapsulating material or formulation auxiliary of any type. The term "parenteral" as used herein refers to modes of administration which include intravenous, intramuscular, intraperitoneal, intrasternal, subcutaneous and intraarticular injection and infusion.

The secreted polypeptide is also suitably administered by sustained-release systems. Suitable examples of sustained-release compositions include semi-permeable polymer matrices in the form of shaped articles, e.g., films, or mirocapsules. Sustained-release matrices include polylactides (U.S. Pat. No. 3,773,919, EP 58,481), copolymers of L-glutamic acid and gamma-ethyl-L-glutamate (Sidman, U. et al., Biopolymers 22:547–556 (1983)), poly (2-hydroxyethyl methacrylate) (R. Langer et al., J. Biomed. Mater. Res. 15:167–277 (1981), and R. Langer, Chem. Tech. 12:98–105 (1982)), ethylene vinyl acetate (R. Langer et al.) or poly-D-(-)-3-hydroxybutyric acid (EP 133,988). Sustained-release compositions also include liposomally entrapped polypeptides. Liposomes containing the secreted polypeptide are prepared by methods known per se: DE 3,218,121; Epstein et al., Proc. Natl. Acad. Sci. USA 82:3688–3692 (1985); Hwang et al., Proc. Natl. Acad. Sci. USA 77:4030–4034 (1980); EP 52,322; EP 36,676; EP 88,046; EP 143,949; EP 142,641; Japanese Pat. Appl. 83-118008; U.S. Pat. Nos. 4,485,045 and 4,544,545; and EP 102,324. Ordinarily, the liposomes are of the small (about 200–800 Angstroms) unilamellar type in which the lipid content is greater than about 30 mol. percent cholesterol, the selected proportion being adjusted for the optimal secreted polypeptide therapy.

For parenteral administration, in one embodiment, the secreted polypeptide is formulated generally by mixing it at the desired degree of purity, in a unit dosage injectable form (solution, suspension, or emulsion), with a pharmaceutically acceptable carrier, i.e., one that is non-toxic to recipients at the dosages and concentrations employed and is compatible with other ingredients of the formulation. For example, the formulation preferably does not include oxidizing agents and other compounds that are known to be deleterious to polypeptides.

Generally, the formulations are prepared by contacting the polypeptide uniformly and intimately with liquid carriers or finely divided solid carriers or both. Then, if necessary, the product is shaped into the desired formulation. Preferably the carrier is a parenteral carrier, more preferably a solution that is isotonic with the blood of the recipient. Examples of such carrier vehicles include water, saline, Ringer's solution, and dextrose solution. Non-aqueous vehicles such as fixed oils and ethyl oleate are also useful herein, as well as liposomes.

The carrier suitably contains minor amounts of additives such as substances that enhance isotonicity and chemical stability. Such materials are non-toxic to recipients at the dosages and concentrations employed, and include buffers such as phosphate, citrate, succinate, acetic acid, and other organic acids or their salts; antioxidants such as ascorbic acid; low molecular weight (less than about ten residues) polypeptides, e.g., polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, manose, or dextrins; chelating agents such as EDTA; sugar alcohols such as mannitol or sorbitol; counterions such as sodium; and/or nonionic surfactants such as polysorbates, poloxamers, or PEG.

The secreted polypeptide is typically formulated in such vehicles at a concentration of about 0.1 mg/ml to 100 mg/ml, preferably 1–10 mg/ml, at a pH of about 3 to 8. It will be understood that the use of certain of the foregoing excipients, carriers, or stabilizers will result in the formation of polypeptide salts.

Any polypeptide to be used for therapeutic administration can be sterile. Sterility is readily accomplished by filtration through sterile filtration membranes (e.g., 0.2 micron membranes). Therapeutic polypeptide compositions generally are placed into a container having a sterile access port, for example, an intravenous solution bag or vial having a stopper pierceable by a hypodermic injection needle.

Polypeptides ordinarily will be stored in unit or multi-dose containers, for example, sealed ampoules or vials, as an aqueous solution or as a lyophilized formulation for reconstitution. As an example of a lyophilized formulation, 10-ml vials are filled with 5 ml of sterile-filtered 1% (w/v) aqueous polypeptide solution, and the resulting mixture is lyophilized. The infusion solution is prepared by reconstituting the lyophilized polypeptide using bacteriostatic Water-for-Injection.

The invention also provides a pharmaceutical pack or kit comprising one or more containers filled with one or more of the ingredients of the pharmaceutical compositions of the invention. Associated with such container(s) can be a notice in the form prescribed by a governmental agency regulating the manufacture, use or sale of pharmaceuticals or biological products, which notice reflects approval by the agency of manufacture, use or sale for human administration. In addition, the polypeptides of the present invention may be employed in conjunction with other therapeutic compounds.

Example 24
Method of Treating Decreased Levels of the Polypeptide

It will be appreciated that conditions caused by a decrease in the standard or normal expression level of a secreted protein in an individual can be treated by administering the polypeptide of the present invention, preferably in the secreted form. Thus, the invention also provides a method of treatment of an individual in need of an increased level of the polypeptide comprising administering to such an individual a pharmaceutical composition comprising an amount of the polypeptide to increase the activity level of the polypeptide in such an individual.

For example, a patient with decreased levels of a polypeptide receives a daily dose 0.1–100 ug/kg of the polypeptide for six consecutive days. Preferably, the polypeptide is in the secreted form. The exact details of the dosing scheme, based on administration and formulation, are provided in Example 23.

Example 25
Method of Treating Increased Levels of the Polypeptide

Antisense technology is used to inhibit production of a polypeptide of the present invention. This technology is one example of a method of decreasing levels of a polypeptide, preferably a secreted form, due to a variety of etiologies, such as cancer.

For example, a patient diagnosed with abnormally increased levels of a polypeptide is administered intravenously antisense polynucleotides at 0.5, 1.0, 1.5, 2.0 and 3.0 mg/kg day for 21 days. This treatment is repeated after a 7-day rest period if the treatment was well tolerated. The formulation of the antisense polynucleotide is provided in Example 23.

Example 26
Method of Treatment Using Gene Therapy

One method of gene therapy transplants fibroblasts, which are capable of expressing a polypeptide, onto a patient. Generally, fibroblasts are obtained from a subject by skin biopsy. The resulting tissue is placed in tissue-culture medium and separated into small pieces. Small chunks of the tissue are placed on a wet surface of a tissue culture flask, approximately ten pieces are placed in each flask. The flask is turned upside down, closed tight and left at room temperature over night. After 24 hours at room temperature, the flask is inverted and the chunks of tissue remain fixed to the bottom of the flask and fresh media (e.g., Ham's F12 media, with 10% FBS, penicillin and streptomycin) is added. The flasks are then incubated at 37° C. for approximately one week.

At this time, fresh media is added and subsequently changed every several days. After an additional two weeks in culture, a monolayer of fibroblasts emerge. The monolayer is trypsinized and scaled into larger flasks.

pMV-7 (Kirschmeier, P. T. et al., DNA, 7:219–25 (1988)), flanked by the long terminal repeats of the Moloney murine sarcoma virus, is digested with EcoRI and HindIII and subsequently treated with calf intestinal phosphatase. The linear vector is fractionated on agarose gel and purified, using glass beads.

The cDNA encoding a polypeptide of the present invention can be amplified using PCR primers which correspond to the 5' and 3' end sequences respectively as set forth in Example 1. Preferably, the 5' primer contains an EcoRI site and the 3' primer includes a HindIII site. Equal quantities of the Moloney murine sarcoma virus linear backbone and the amplified EcoRI and HindIII fragment are added together, in the presence of T4 DNA ligase. The resulting mixture is maintained under conditions appropriate for ligation of the two fragments. The ligation mixture is then used to transform bacteria HB101, which are then plated onto agar containing kanamycin for the purpose of confirming that the vector has the gene of interest properly inserted.

The amphotropic pA317 or GP+am12 packaging cells are grown in tissue culture to confluent density in Dulbecco's Modified Eagles Medium (DMEM) with 10% calf serum (CS), penicillin and streptomycin. The MSV vector containing the gene is then added to the media and the packaging cells transduced with the vector. The packaging cells now produce infectious viral particles containing the gene (the packaging cells are now referred to as producer cells).

Fresh media is added to the transduced producer cells, and subsequently, the media is harvested from a 10 cm plate of confluent producer cells. The spent media, containing the infectious viral particles, is filtered through a millipore filter to remove detached producer cells and this media is then used to infect fibroblast cells. Media is removed from a sub-confluent plate of fibroblasts and quickly replaced with the media from the producer cells. This media is removed and replaced with fresh media. If the titer of virus is high, then virtually all fibroblasts will be infected and no selection is required. If the titer is very low, then it is necessary to use a retroviral vector that has a selectable marker, such as neo or his. Once the fibroblasts have been efficiently infected, the fibroblasts are analyzed to determine whether protein is produced.

The engineered fibroblasts are then transplanted onto the host, either alone or after having been grown to confluence on cytodex 3 microcarrier beads.

It will be clear that the invention may be practiced otherwise than as particularly described in the foregoing description and examples. Numerous modifications and variations of the present invention are possible in light of the above teachings and, therefore, are within the scope of the appended claims.

The entire disclosure of each document cited (including patents, patent applications, journal articles, abstracts, laboratory manuals, books, or other disclosures) in the Background of the Invention, Detailed Description, and Examples is hereby incorporated herein by reference. Further, the hard copy of the sequence listing submitted herewith and the corresponding computer readable form are both incorporated herein by reference in their entireties.

SEQUENCE LISTING (1227 sequences)

SEQ ID NO: 1 - DNA, 733 bp, Homo sapiens
gggatccggagcccaaatcttctgacaaaactcacacatgcccaccgtgcccagcacctgaattcgagggtgcaccgtcagtcttcctcttccccccaaaacccaaggacaccctcatgatctcccggactcctgaggtcacatgcgtggtggtggacgtaagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaacccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagtgcgacggccgcgactctagaggat

SEQ ID NO: 2 - protein, 5 aa, Homo sapiens
  Site (3): Xaa equals any of the twenty naturally ocurring L-amino acids
WSXWS

SEQ ID NO: 3 - DNA, 86 bp, Homo sapiens
gcgcctcgagatttccccgaaatctagatttccccgaaatgatttccccgaaatgatttccccgaaatatctgccatctcaattag

SEQ ID NO: 4 - DNA, 27 bp, Homo sapiens
gcggcaagctttttgcaaagcctaggc

SEQ ID NO: 5 - DNA, 271 bp, Homo sapiens
ctcgagatttccccgaaatctagatttccccgaaatgatttccccgaaatgatttccccgaaatatctgccatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctt

SEQ ID NO: 6 - DNA, 32 bp, Homo sapiens
gcgctcgagggatgacagcgatagaaccccgg

SEQ ID NO: 7 - DNA, 31 bp, Homo sapiens
gcgaagcttcgcgactccccggatccgcctc

SEQ ID NO: 8 - DNA, 12 bp, Homo sapiens
ggggactttccc

SEQ ID NO: 9 - DNA, 73 bp, Homo sapiens
gcggcctcgaggggactttcccggggactttccggggactttccgggactttccatcctgccatctcaattag

SEQ ID NO: 10 - DNA, 256 bp, Homo sapiens
ctcgaggggactttcccggggactttccggggactttccgggactttccatctgccatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctt

SEQ ID NO: 11 - DNA, 2526 bp, Homo sapiens
gacaggctatccgagaatctgagagctgggcccggcaattcctccagytacccttgtgacctaagtccagtcacacatttcccaaagtttctctttgtcataaccctggtctggctggttttgrggrcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagksagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgamcttctgaartgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttattttttgtgctgggtggacatttgtattttgttaggttgctgtttaagctcaagtttgctgtgctctctgcagctacaaaacatcttggcatatttaagaktggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactctttttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcatttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttgggggggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgcacaatgggggtggaaaacttttgtatccctaagcatattattttatagtgtctgccatgccatgtggaaatactttatttttaacctcaggatttaaataaagtaaacactatgacatttaaaaaaaaaaaaaaaaaactcgaggggggcccggtaccca

SEQ ID NO: 12 - DNA, 1131 bp, Homo sapiens
  SITE (839): n equals a,t,g, or c
cactgcaccagctttgttatctgtaaaatgatgataataccaacaccttcttcttggggtactgaagatgagagaacatgatatgtgtaaagtgccttccacaatacccagaacatagcaaacatgtaatgaatgtagtaatagtaattattttattttcttttgattcagttgggactatgttcagctgtaacagaatacccaaaataactgttttaaacaaattaaagtttwgttgtgaagttttgttacgaattcagacaatccagggcttttatagatgcaccaggatcagcaggtacaaaggcatctttcctgatttctgccagtctcaatgcatgggttgcaatccagartccargatggcagttccagccctggttacgcccatattagcacacagaaagaaagagaaagggatgtgcctcttcactttaatcatagctcccactagatgcacccactacttctgctgatactccattagctaatgcttgcttacatggtcacacttagtttccagagagacatgtctggacagtcatgtgctcaattaatatccaagtgtccaattactgagaaaaaaagaaactagcacctttgcttggttgcattcctcttagcataagccacattctttttatgaagttgtcctcagttacttggatgcctcagttgtcctttcawttagaaawgcycctkggacaycctgaawctgacttcttttgtcatcagcaccatcactaccactgccytcttcaaagccaccacgttctgtccccaggatggttgcaacaaccaccatagggactttttgccttctacttccacacaatagnccagagtaagcttttgaaaatgtaggtcagatcatgtctctctcttcctcttcaaaaccctcccgatggcttttcatattactcaaaagaaaacctaaaactttgctgtgagatctatgtgacccggcttattcttcctcttactttatctctgtattgctcttcctcactctactccagccatcccacctccttgctgcttgtcctatactcctaaaagaagttcagtcttcccttatgatatttgcacttaaaatagaaaaaaaaaaaaaaaaaaaactcgaggggggcc

SEQ ID NO: 13 - DNA, 941 bp, Homo sapiens
ggcacgagtagcatttcatttaatctgcaggtatattctcccaacagtttattgtcatgtgatgtcctcagccaagattgtraggcagagaggagctgtcccaacctactataccaccgaggctggagagatcatatttttggtattaaactggagtctctccatccttcacattgttgatgtcctctgtagcaaaccggaaaagtcagtgacagaagatgccgctagcggtttgagccagagaatgacagctctggtttggagaaaagggccggatggtggctctagaaagcccatccttctgctcttcttttttctcccccttatattgtgctttcattcattcattcattcatcaaacatttgttgagcacctattatgtgtcaagctctgtgctagcctctggaaaacctgccctcatgtagctcactgtggagtaggagaaacaatgactacactatgataagcacgggttgtcagggtctcacagagcagtggcccctcatccagaccgatgaggtcaaagaaggcatccaggcgaggatggtgtcagagctaactgaagaatgagagggagctgcaccascaggggttggaactgaaggtggcagtgcctggagtcttgattccagcagagggagagcagtctgtgaaaaggcaccaagggtgggagagggcagagcacatggaggaacttcaggtagttctggatggcsctggggcaaagctagagaggtaagaagaatctacaaatgttcctcgagttacatgaacttccatcccaataaacccattggaaacgaaaaatttaagtcagaagtgcatttaaggctggtccgagtagaatgatttttacaacgaattgatcacaaccagttacagatgtctttgttccttctccactcccactgcttcacctgactagcctttaaaaaaaaaa

SEQ ID NO: 14 - DNA, 843 bp, Homo sapiens
  SITE (2): n equals a,t,g, or c
  SITE (19): n equals a,t,g, or c
  SITE (87): n equals a,t,g, or c
  SITE (89): n equals a,t,g, or c
  SITE (525): n equals a,t,g, or c
cnagggataaccccaaagntgggaaataaaccctcaattaaagggggaaccaaaaagctgggaagttcccccccgcggtggcggccngntctaggaactagtggaatcccccggggctgcagggaattcggcacggagtgggaatgttgtttgtatgatactatttccacaawatgcattgagacttggtktgtggcctaggacatggtcaattctttytaaatattccgtgaatttctttagtgcatattctccgatgggggctgtggggacagagttctaaatatgcccattagattaaatctcttcattctgttgctcacatcttctatatccttattaatctgtcaatctcttcaagagaggtgttattaaaatctctcactgtatgtgtcactttgcccttaaaattctgatgatttgctttataaatggttataaccattttccaggaagaacattaaagaactttccattggcattatccagtttccctcaaaatactggttttttttattttggctnctaagcagctatgaatccagtttctcagaagcccttgtctcaaggcatttgtttccagattaccttgttagcatccacactatgggctattttagaaaaacaaaaaaagtatcaaaatcatatagctatgattttcctgtgcttgaaggagccttaaagctcatctagtccagccagtatttgttcatccaaattctgccaagaaatctctattgtcaagatattctttaccatctttgggacattctcattattagaaacaaatcctaagaagaaattctgccatakacaacccatccgttctttaaaaaaaaaaaa

SEQ ID NO: 15 - DNA, 1018 bp, Homo sapiens
ctgtaatttttaattttcatataccgtgctttgattctaattttattttttgagttctctgaaggttacatatacagagtgcttcaggaatgatcattttgttattattcatgcttcttaacaatgttgttttagtccaagaagataattgccagagaaagaatacagtgcaggaaagaagargctggagccagtggtgaagarggattgagargacagacattgtgggaatgaaatcatgaataatcgtgtttttgaattgtccaaaaacttctacaaaccatgaaatgttggagtttaaatctaattgttgaaaaattccccacattccttgtatcccttaggttgagcataattccacatccgtggactgatgcacttcccaagagggggcctcattaactcttccgaggcagcagcagcaagggcaccccctcctttccccccacaccccayttctcatggctcttctttctctcatctcatgcttaggttagaaaagggcacaaggtaaggaagcccttgggaataggctgaatctggctatctaatttggtgccaaatacttaatgtgcttgaatttaaaaacagcaaacatgtagaaaggtaattataattatgaggccagttctttaagctagctttttttcccctctcaaacagcatattggcttggatgtcagcaggagaaagtgttttttgcaatacacataatgcatatatggtcctgttagcaatctatagaaaatagatattgctcattaaggtaaatatttttgttgatgaatgatctggaatggtctggacttgttgtgtgaacaggaaattgctctgtaggctttgacttgtgaggtaaagagtgaggctggtaagattaattaaagtaaatactgtgacaataggatgtcaaaaccaaaaacgtgtttctgaaactcaaggaattaatgacacatagggaagtttttgccatattaagcatagagtaggagaggcaagtcaagaataaaaaaaaaaaaaa

SEQ ID NO: 16 - DNA, 661 bp, Homo sapiens
  SITE (25): n equals a,t,g, or c
  SITE (478): n equals a,t,g, or c
  SITE (661): n equals a,t,g, or c
tttaagaaattagtgaatccccggntgcagggaattcggcacgaggaggaggccgtcagctggcaggagcgcaggatggcagctgytcccccgggttgcacccccccagytctgctggacataagytggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctmtccgagctgctggagcatggagtgtgtgaggaggtggagagagttcggcgctcagagaggtaccagaccatgaaggtgcgcagggcagggctcggacctaccccaggaatgtcctgccctgggaatgacaacacagtccacaccatgcacggggaggcaaacaggggcagctgacccagcccaggggtcagangaggtcttgccgaggaagtggcagctaagctgatacctgatatgcacwagkcagccargyggagacaggcaaggaagaagcttgttttgaggacagaattttctagatcactcagcaccatctggcttttggggctttttgttttattttgtttttgagacggggtctcgctctgtcgcccan

SEQ ID NO: 17 - DNA, 553 bp, Homo sapiens
  SITE (507): n equals a,t,g, or c
ggcacagggctatttgcccctctctccacatgacagaactgctctaagtttctttgctgctcttctcagctgtcagacggcttgctgcttgttttccacaccaccatgtctattctttgctgtccttwactctgcctgtttttttccttttgtatttcttctggctcttgtcccttttcccacgtgtcwcagctttcctttattgccactttcagtcagagcagtcctgtgcttctggtgccggcatacaatacttacttgagtttcttggcttttcttgactgtgcatctcttacttcaacataggaatagcctgtcatagaatttctccagttccagggctcaagagggagagtgccagaaaattgagactgttttccctgtcttggattgaattcataaagcaaaaccagtgtttgtgtgagggtttgctgtgtcatgcctataggttgtttgggtgcaaacctatagaatccagcctgcgaaaagaaagraaccagagaatancagcatcagaacaatgcttgacatcatttctcaatcaagcagtcca

SEQ ID NO: 18 - DNA, 869 bp, Homo sapiens
  SITE (635): n equals a,t,g, or c
ggcacgagctgccaacactgaggtcttcgtggcttctcacatctagatgtatccctctcaaatctatcctctatccaggcaccagattgaggtatctaaaatgtcaactttccagttactccttcttatactagcccaatcaacttacaagataaagtccaagccccttcatatgacaaaccacaccctgcttaactctccaggtttgaatccttcatctcctactttaaactttaaaacccagcagcacgaaagtgtctcctatgcatgttgccatatgcgttctctccatcatgcatttgcctgagcaagatgtcttgagttaacatcttattctttaagactcattgtggtggtagacagcctttaataacggatccttggccaggcacagtgactcacacctgtaatcccagaactttgaaaggccaaagaaggaagaaagcttgaggccagtagtttgagaccagcctgggaaacagagagatatcccatctgtaccaaaaatttaaaaaaatattagcagggagtagtggcatgcacaagtggtcccagctccatgggagastgaggtaggaacatcacttgagcccaggaagtcaaggctgcagtgaaccatgatcagaacattgcantccagcttgggtaacagagtgagaccttaggtcagaaaaatgaataaataagcataaaattttaaaaacttagccaggcatggtggcacacatctgtggtccctgctacttaggaggctgaggtgagaggatccttgagcccaggaggtcaacactacagtgagctatgattgtgccactaaactccaacctgggtgaaaaagcaaaaccctgccaaaaaaaaaaaaaaaaact

SEQ ID NO: 19 - DNA, 959 bp, Homo sapiens
  SITE (930): n equals a,t,g, or c
ggcgagccgagatcgtgccattgcactccagcctgggcaacaagagtgaaactctgtctcaaaaaaaaaaaattataatactatatgccataaaatgacatttcatatttaaagagttttttaaaactcttgtattcacatgccataatttgaaaccctatttcactgaatgagaatggtatctgttgtcctcattttttcatttttatccttaacaatttccaccacagccagtgcatataatggcaatgacacccagggatggaatgataagttccatcrcmgctcagtcaagacgcagacttgatgtggccccaacaacagtcaataatggagtctccaaaataaagctctataggaaaggtaaatacccgctgcacaagaaaccacagcatctaggttctaaccccatctctatgaagagcttgctgggagagttttgacattwaacaatctgtctgatkgccaattttyttcttctataaaatgataatgttkgaytcaaagatccaaagtcaattcatggtctaaaacttaatgatttttttaggttttgkgacatttcactgtacactgtagtaatttatatcttattttcccactaatttagaaaaatatytaaatgatccttaattggcaatgggtcctaagaattttgttttaaatccctgttacccaaaagagcccttttttgtatctcgcagtagttacaaggatctttctaaatcttaaaaaaaaaaaaaaaagaaagaaagaaaagaaaagaaaaaaagtcagccgggcgtggtggctcatgcctgtaatcccagcactttgggaccaaggtggacagatcacgaggtcaggagatggagaccatcccggccaacatggagaaaccctgtctctactaaaaaaaaaaaaaactcgaggggggcccggtacccaatncgccggctagtggtcgtaaaacaatcaaa

SEQ ID NO: 20 - DNA, 1446 bp, Homo sapiens
cggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatragaaaggcccagaacgtgcaggtctgcggaggggaagtgtcctgagtgaaggaggggacccccatcctgggggatgctgggagtgagtgagtgagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccstagacctgctccccagaggaggggccttgacccacaggacgtgtggtggcgcctggcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaagccaaaaaaaaaaaaaaaaaactcgagggggggcccgtacccaattcgcca

SEQ ID NO: 21 - DNA, 1471 bp, Homo sapiens
  SITE (1470): n equals a,t,g, or c
caaaaaataataatgataatttaaaataaataagtaactaataaaaagattttatatcccagtcttatgatgttggttggcaaggctagataaaaagatgttagaatgaaagaacatatttttagtgatatgtaaatgaaggattctacaatagtcatatatttttatatgaatgaatgttgggttgggctggagaggtatgtgtgtgtaaatataaaggtctcacattcagagtatagctctgaaataatggaactcatgtctacaattcaacatgcatctgtatagttacatctcatgtaaatatacacagacatattttgcagccagtaattgacagttaatgtccaaaacaggtgattgataggtaacagaaattagataaccaccaattttgcccaagagaaagactagaaggactaaaagcagttgaatgtatggtactgacattgtcataagcagtctgataaccagtttattgaaacgtgtgcattaacagagaatttaattttaaacccataatttctcctatccattaaaatattataattgttagtagtatgaaaccaacaggaaatgttttttaatcatttagtgaggtgattcatttgtttcatgggcaaacactatccaggaaaagccttgcttgcctgtttcccaaagagctctaagaaatagaatcaagtgtaaaatggttcagaccattcaggatttcttgtcactcttctcaaccccgatcttcctgttattactgatgtttgaaaccctgtcattagccccggcctggttaaagcccctcagagtcacctctcattcatagcaatagaattcaaccccaagtggttgatggtgtccccagcacagccgagagacctgatctctggattcagtgcttttagctcttcgagtttaccctaagataccttcgggcaatatttttaaccaacccaaaagctcttcaggtcatttctgaagaggacaaggtgaatcttggcttggaacaccatttttgggctcttgctactgaatgaatcagaaaggaattttttctgaagagcattagaaagtaaaggagatgttaaaataagttcttgaagtatgttttatatttatctaaaacactgattttaaaagtttacattcaaatgtgtattcaaaagaagtactgatttgtaattattatagtttgtgtgtatcatccccttttaaccgtgcctaacaactgtacttaaattttgttttcctagtgtaacaaatgtttcccataagattttctagagccaaataatgggagtgaaaaattccttaagtgttatataagaaaatatattagaaaatcagctttggattatacgatttctaaaatatactaatacagaatcctcagtaatatgttttgaattggattttttctcagaactgttacataataaataatacatcaaccagaaaaaaaaaaaaaaaaaattnc

SEQ ID NO: 22 - DNA, 1402 bp, Homo sapiens
agggacgtcttgcctgaggagatgcccatttctgtcctggrttaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttamttcccccamcctcctctcttggatatggttggttttggctcatttcacaatcagcccaaggytgggaaagctggaatgggatgggaacccctccgccgtgcatctraatttcaggggtcatgctgatgcctctcgagacatacaaatccttgcctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataataaaaaaaaaaaaaaaaaact

SEQ ID NO: 23 - DNA, 1047 bp, Homo sapiens
  SITE (301): n equals a,t,g, or c
ggcacaggggactacaggcacccacgaccatacccagctaatttttgtatttttttgtagagatggggtttcacgatgtcgcccaggctggtcttgaactcctgggcttgagcgatcttcccatctttccatcttggcctcctaaagtgctgggactgcaggcatgagccaccatgcccagccaagattcttattgattaccatgttgcttcaagaagccaagccagtttccaatattccccatttgctggagtcttggtactttgggtagaagcaactggtaaattgttaattggaacanttggtggtgtagataaccacgtatggccaaacctagagcatctaggctcacaattactatcctgacttgataacaagtgttctgatattaacctgaaaatgggaataatgccaaatctgtgtaacttaacatctatatacacagtggggagaactgaagttattaaacctggaatctctgtgatcaaggctaacagtagttatctaagaagcaaaggacctacaattcttagacttggagtcatattctttaaggacgtgttctgaaactatatcaagcatctggtttccacgtatttctccctcagaaattatgaagtacaagtaaaaatgaaggtacagggtaagacacatgctgctttcttgctcttgagtggagacagttttccagccatcttaaccccttwacacaaaacaatttgtgttttatagcaaataagtgactcaacataatttcaatatgatgtttatccaccagtactttcctttcagcttctagtcccataartggtttgtgaagtcatcggttacattagccaagataggcctagacttgaagtctagaatgtttttcccactatatgccaaagtagaatgtgggtatctcagggtcatttttgttgttcaatttcccacctgtacagttgttatgattcactttccttatgtgtctaataaatcttgttccatgaaatgatcaaaaaaaaaaaaaaaaaaactcgagggggggcccggtacccaaatcgc

SEQ ID NO: 24 - DNA, 990 bp, Homo sapiens
  SITE (834): n equals a,t,g, or c
ttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctggaataaggatgatattcgttgtggttggcctaccaccataactgttcaaacaaaagaccagtatggggatgtggtacatgttcccaatatgaaggtaattataactggattaaattagcagacatctatatactggctgcaatgactgataaaattttagaaatgccaagtgctgagrgtccatttgttctaccctctttatataaagggtgatgctgaaagtttgtttaaatgacttgtttatattaattagtccccaagtgtccaagttacacctgttttttttgtgagtttgttctttacattttgctacctgttacggggactcaaaggagggataagaaagtatccatctaaagagtgctagacacatacagtgaagcccctcaatatgtattgattgaataaatgcatgaaagaatacatttttaaattttgtgtatagttttgaaagactcaagtacgttctgtgtttggtattactgaaaccacattttaaaaataacactcattaagttagaaatatatgagtttagattgtaaaagaatgaggaattgaaatagttgtataccatattgatgaatatagagtttttaggatacctcttacctgaaatattaataataatgtttncagagcatattatacataattatttgtgatttaatctgttaatatgaatatctcatttaaaacttttatttctgaaaaaattatattgaataaaattttatataggcagtccccagccctttcctccttcaaagttgtcttatagagtgattggtt

SEQ ID NO: 25 - DNA, 1208 bp, Homo sapiens
taatcgctactatagggaaagctggtcgctgcaggtaccggtccggaattccgggtcgacccacgcgtccgagcgaaatggcgcctccggcccccggcccggcctccggcggctccggggaggtagacgagctgttcgacgtaaagaacgccttctacatcggcagctaccagcagtgcataaacgaggcgcasgggtgaagctrtcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcktggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccrgagacgctggtcaacctcatcgtcctgtcccagcacctkggcaagccccctgaggtgacaaaccgatacctgtcccagctgaaggatgcccacaggtcccatcccttcatcaaggagtaccaggccaaggagaacgactttgacaggctggtgctacagtacgctcccagcgctgaggctggcccagagctgtcaggaccatgaagccaggacagaggccaggagccagccctgcagccctccccacccggcatccacctgcatccctctggggcaggagcccacccccagcacccccatctgttaataaatatctcaactccarggtgttccacctgaaaaaaaaaaaaaaaaaaaaaaaaaaaaaaaaaaaaaaaaaaaa

SEQ ID NO: 26 - DNA, 1922 bp, Homo sapiens
  SITE (1022): n equals a,t,g, or c
gtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggccnaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtrcgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgccccaaaaaaaaaaaaaaaaaaaaaaactcgagggggggcccgtacccaattcgccctataa

SEQ ID NO: 27 - DNA, 1951 bp, Homo sapiens
  SITE (1892): n equals a,t,g, or c
  SITE (1930): n equals a,t,g, or c
  SITE (1934): n equals a,t,g, or c
tcgtccccagagcgggctgagccccaggcgsagggtggcgggggagcctgggggagccgccgccacctccacgggcctctctgagctcggacaccagcgccctgtcctatgactctgtcaagtacacgctggtggtagatgagcatgcacagctggagctggtgagcctgcgccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggaactccacgcctgatgaacccgacgtccatttctccaagaaattcctgaacgtyttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtggggcgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcctgtcaaaaaaaaaaaaaaaaaatcggggggggcccggaanccaatttcccccaaaaaggggggttataaaaattcccnggcngtgtttttaaaaattcg

SEQ ID NO: 28 - DNA, 3989 bp, Homo sapiens
  SITE (17): n equals a,t,g, or c
ggcacaggccgcagggnacctatgggcgcatataggttgtaatgaaactgtagtctcagttggaagcctagacatgaaatgggtcagtgagcaaggctctattcctagtctccagccatgcctgtggaacctgarcccrctctcagcacattggacccaggcagatgyaaaaaattcacagaactatgatttggactcaagggtttgtagatttcctccttcattctaatttcagtgtctaaaattcttgcatccrtgaacgagctgggcatttgatgagacagggcygaatactgcagttttcctcctagaaatcatctggggcattttctttgaactgatgggaacaataaggcataactgtttgcacaaacttgggataartgattttgggataacgatctaccagaatggggatatttcacccttggttctgagatgcaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaaytaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagrgcctgaagtcttgcaggactcactggatagatgttattcaactccttcagttgtgttgaactgtgtgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgckgtttactcattggaggamcaktaccttggcttkkctcttgacgtggasaaattgaaaagaaggggaaggggaaraaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttayrtattggagcaacagygtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaamgaagraaagaagaaggggaagaaaagaaggggaagaagatcaaaacccaccatgccccaggctcaacggcgtgctgatggaagtggaagagcstgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttastaakccgagagatgtcattcctgcaggcaggacctataggcamgtgaagatttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcrgacattttaatttgaaccacgtatctctgggtagctacaaaattcctcagggatttcattttgcaggcatgtctctgagcttctatacctgctcaaggtcaktgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctagrctcctttggttagagaagccacagtccttcagcctccaattggtgtcagtacttaggaagaccacagctagatggacaaacagcattgggaggccttagccctgctcctctcrattccatcctgtagagaacaggagtcaggagccgctggcaggagacagcatgtcacccaggactctgccggtgcagaatatgaacaaygccatgttcttgcagaaaacgcttagcctgagtttcataggaggtaatcaccagacaactgcagaatgtrgarcactgagcaggacagctgacctgtctccttcacatagtccatrtcaccacaaatcacacaacaaaaaggagargagatattttgggttcaaaaaaagtaaaaagataatgtagctgcatttctttagttattttgarccccaaatatttcctcatctttttgttgttgtcatkgatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctyagcccatctgcgggcagagaaggtctagtttgtccatcascattatcatgatatcaggactggttacttggttaaggaggggtctaggagatctgtcccttttagagacaccttacttataatgaagtatttgggagggtggttttcaaaattagaaatgtcctgtattccratgatcatcctgtaaacattttatcatttattaatcatccctgcctgtgtctattattatattcatatctctacgctggaaactttctgcctcaatgtttactgtgcctttgtttttgctagtgtgtgttgttgaaaaaaaaaacattctctgcctgagttttaatttttgtccaaagttattttaatctatacaattaaaagcttttgcctatcaaaaaaaaaaaaaaaaaaaaaaaaaaaaaaaaagcggacgcgtgggc

SEQ ID NO: 29 - DNA, 3735 bp, Homo sapiens
  SITE (110): n equals a,t,g, or c
  SITE (3690): n equals a,t,g, or c
  SITE (3716): n equals a,t,g, or c
ctgctgttcgctggctgggctccgcagcaggcttggccagcsgctgacgggtcggcgggcgggtttgtgtgaacaggcacgcagctgcagattttattctggtagtgcanccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttwttgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctcccttttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaaagccgatatagtagctagctacttaagcatccatgggtattgctccatatcaaagcagatttgcaggacagaaagagtaaattagccttcagtcttggtttacagcttccaaggagagccttggccacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaattaaggcctcacaggatgagtctccattctctgtaaatgcttattttatcatagtctttagccnctactatgagtaaaatgttctcttcngccgggtgtggtgactcac

SEQ ID NO: 30 - DNA, 1667 bp, Homo sapiens
  SITE (1628): n equals a,t,g, or c
tagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggraaaaaaaaaanwaaaaactcgagggggggcccggttacccaattcgccct

SEQ ID NO: 31 - DNA, 1408 bp, Homo sapiens
  SITE (1385): n equals a,t,g, or c
  SITE (1395): n equals a,t,g, or c
attacacacctgagcactgtgcctggcaagacctgtcttaatagattagagaaccactgatagatggtcagctttctgtagcagtgagaaccctacatttcaaatgtggatagcacctttgcggggaaacatcacttggcacatctgcattcttttttgacacagggtctcactctgttgcccaggctagagtgcatggcacgatcttagctcactgcaacctccacctcccaagttcaagcgattcttctgcctcagcctcctgagcagctgggatcacagacatgcgctaccatgcccagctaattttttgtattttttgtktgtttgtttttgtttktaagtagagacgggctttcaccacgttggscaggcaggtctcgaactcctgamctcaggtgatccacccacatctgcgttccaatatctttctcaacataatgatagccgtaattaatattttccagtacatttttatgcctttacacacgagagtggtagacagacacaaacccagatctgtctgactccaaagcccgtttgtcatcattccttttacggtatcctatagtggtatcctttacagaaagacagcttttacccaacaaagacttaacttcccaggatgccagaaggacaaagcgggattgcttttaagragraagttatcaagamcttattttataaatgagattagatagggaaaggcaatttatctttattaaaaactgaaaaggccagcatagggaaggaggtccttcggtggtctttttcagggaaatacttcagttgcttttattagaaacagatagtacctaaggttttgaggtaggwacagcttaaggcatgctaatgktcatgggtccttccatagtcattttkgtattttggttwacatttgagcaataggcagcccttcactgctgctggaytcattcctgccaytattacaggtgacagaggagacaggaggtatgtcttttctatttttawacatgctttatatttaacacaagctcttgggtatcttagataaacagaagttgcctagcactccttttagtgcattgaaccctttaacatttaagcaaaataataaacagtcttttgaggttccttaacaatgaaacgtgttcgagtggcagcagcggaatccatgcytcttctcctggagtgtgcaakagtccgtggtcctgagtatctcacacagatgtggcattttatgtgtgatgctctaattaaggccattggtacagaaccagattcagacgtcctctcagaaataatgcattcttttgcaaaggtgaatatttttctcttaaaaaatatgtataaggtggtatgttcatttattagtcttgctaaaaaaaaaaaaaaaaaacttngagggggggnccggtacccaatt

SEQ ID NO: 32 - DNA, 3186 bp, Homo sapiens
  SITE (24): n equals a,t,g, or c
  SITE (666): n equals a,t,g, or c
  SITE (682): n equals a,t,g, or c
  SITE (3181): n equals a,t,g, or c
  SITE (3184): n equals a,t,g, or c
gggaggtcgagaagccaataagtngtttttcattgaatcctgcattgcactctttgtttccttcatcatcaatgtctttgttgtctcagtstttgctgaagyrttttttgggraaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttytgaatgttctacagagcttacagcttccctttgctctcatacccatcctcacatttacgagcttgcggccagtaatgagtgactttgccaatggactaggctggcggattgcaggaggaatctggtcctatcatctgttccatcatatgtactttgtagtggwttatgtccgggacytaaggcatgtgscattatatgtggnggctgctgtggtcaancgtggcttatctgggctttgtgttctacttggrttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttacatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaaaaaaaaaaaaaaaaaaaaaaattnctngg

SEQ ID NO: 33 - DNA, 971 bp, Homo sapiens
  SITE (957): n equals a,t,g, or c
  SITE (964): n equals a,t,g, or c
cgcgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaaaaaaaaawwaaaaaaactsgaggggggcccgtacccaantcgccgnatatgat

SEQ ID NO: 34 - DNA, 1792 bp, Homo sapiens
  SITE (1767): n equals a,t,g, or c
  SITE (1768): n equals a,t,g, or c
gaaccccctttctcctggtaaagggtaaggggggggataatgtttaccacaggtacgaaatagtcactttaacattgagacctctgcctcattgaattcaggttttttaagtacttgaaactcttcagattctccttattttagtttctttttacatttatgaagtagaaagcattgttttgtaaactgttttgaaaataaatagcctagtctcttatcctctttagcgtggattaaaggtgaagttctgcaaatgggagagtgttcacagtagatagctcagattgattgaacacatttgaggaagagactcctgcatgagataccagcatttttacaaatactttttatgtacattctttattttgtcattttgtcaaccctctccccaagcacatcttctttccttttactatgtctatgtagggaaaaacaaaacaaaaaattgcacttacgttacactcccaaaatgtgggtaatccgtgtctttcaaaaaacatttctgttttttgttttgttttggtcagtccattgcataagtgacaagtttgggtgcttgtggcacgtatgtatgaagcgggagggggatgasaattgcctgtccttcagtargctgtaaaagtaatttacatgtaagtaaaaagggaaaatagaatagatgccaaagtcatttattcagtccttagttttcttatgtggcattactgcatctgctagttagtgagaaagcaccctcagcttttactgctcccctccctgcctgccaacacacttgatgtgtgcaaacagccctcaagtatctgtcagatgacctatataaggtattgaataaggtattcttgtcagtttagaaatggactggataaaacttacttggttgtcattattttatctcatttgtcctgttacatgccctatgttaagataattatattgccactaataatcaagatgctaaatgagtattacaactggctaatatcattttttatatacaagggtatgtgtatatttggaattgrtatgagaaactcatttgtacccatttgagtgatattgcacaacaaacacagatayctacagactccgttttcattttctcgtgttctttatgataatgatctttgtagattggttatttctgtactttatctgtaataaactttgtagatcctgtgaaccattactttgcctaaatcacttgagacttgagtctttaataacaaagcatcaatattcactaaagtcaatctcttttgagtttctgtgacttggctagaagctcttgacactaagggattagtgttaattttccctgggggtgttccactagggcattactgtataatgacttgatgttgccacatagacttcaagatatataatattttgaggattttgttgattggcctatgttttattgcatagtgtgaaacgtgtaaagcttggttaacctgtatatagatagcttattgttgactagttatagtgtatttagggttgcctgtaatatttaagcttctttactgatgtgtgtgctggtaggaacatataatttttgtacattatatttactgagatgttgccttttttattttacaaatactttggaattccaatgtgttttttgcttccgtgaggattaatttggaaaggtttttaatgacattccactgatttcagattttgcttgagattgacttcaataaattgtcctgtatgttccaaaaaaaaattaaaaaactcgaggggggcccggtacccaanncgccggatatgatcgtaaacaatc

SEQ ID NO: 35 - DNA, 896 bp, Homo sapiens
  SITE (6): n equals a,t,g, or c
  SITE (8): n equals a,t,g, or c
  SITE (870): n equals a,t,g, or c
  SITE (877): n equals a,t,g, or c
agttgnanacaacaggacctgagtccttgggcagcaccagtaggttgccccytgcytcytgccagcytcacytgccacyttytgcccctytcgggatgccttcgcagacagagytyttcgctgcctgtggtggccaytctttgcttttggttytcttgccccttggcctccctttttgtccccgggcagccttgtgtgacctgcccttttccctcccttcctttccaggacaagcacgccgaggaggtgcggaaaaacaaggagctgaaggaagaggcctccaggtaaagcctagaggccaaagaactttccaggtcagccggacagctccagcagctccacgttccaggcagcctcgmccgccggctgcgctcccagcactggggtttggggggaggggggtggccaaggggcgtttcctctgcttttggtgtttgtacatgttaagaattgaccagtgaagccatcctatttgtttccggggaacaatgacggggtgggaraggggagaggagagagtttgggaaagggagatggagaagaactcaaggacattgcaaccctgcccggcgcagatctgattttcacatctctacctggacattgagcctcccaggcaccatgttgaggagagatgaaaaccagggcggtagaacttcagggtgaaggacagagtcctgggtggggcagcggctgcagggcgcaccagagaacccagccagagggggtgtgagtaccagtggtgttgcttccaccctgcagcaggtgggatgaggtctgtgtgtgtgtgtgaaccatcattttttgatcatcatgaccaatgaaacattgaaaaaaaaaaaaaaaactggaggggggcccgtacccaantcgccgnatagtgatcgtaaacaatc

SEQ ID NO: 36 - DNA, 912 bp, Homo sapiens
tcgacccacgcgtccggtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccakccgcggcagggctcgctggggtctggcctacacgctgctgcacaacccaaccctgcaggtcttccgcaagacggccctgttgggtgccaatggtgcccagccctgarggcagggaakgtcaacccacctgcccatctgtgctgaggcatgttcctgcctaccatcctcctccctccccggctctcctcccagcatcacaccagccatgcagccagcaggtcctccggatcacygtggttkggtggaggtctgtctgcactgggagcctcargarggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccytcagcgccacggacctytytggggagtggccggaaagctcccsggcctytggcctgcagggcagcccaagtcatgactcagaccaggtcccacactgagctgcccacactcgagagccagatatttttgtagtttttatkcctttggctattatgaaagaggttagtgtgttccctgcaataaacttgttcctgag

SEQ ID NO: 37 - DNA, 1382 bp, Homo sapiens
  SITE (787): n equals a,t,g, or c
aattcggcacgagcggaggcgagggaaactragggcgaaagttgtgtgtcgtgttggcaggagggcctagaagggaaagactgtctagtgggacaatgtcatattataaatttggaatgctgaatagaaaattatagattttgatattgaaggaaatgaagcgaagcytaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttkgctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggrataaaaatgattttaagcctcaatgtaaacgaacaaacttagtggcaaatgatggaaaaaattcttgtccaatgagttcgggagctcaacaacaaaaacaattaagaacacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataaganacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgagcaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaaaaaaaaa

SEQ ID NO: 38 - DNA, 872 bp, Homo sapiens
gggctacttcaaagccctgggccttatttcttcaggtaaaaaaatataaagtcagatctcatcccggctggccatgctgttagaccctttcatccttctcttctgcctcttctcaacagctgcccagtcctgtttggaattcatatacatacagttctaatactgatgtatttaccctcataagccactcaacccagaatcttatttgaattataatccagaaacatcaggtgacgtgtgagactactgtatgagaaagagacagtttaagggtcagtccaatggaaaaaagagttctcagagctttctttagcttattctcatcaaagagctttctctgcagaaggaacctactggttcctcctttccagtcctagaaatcctgacctagagtggcttaatcctgctagcacctctctctcgcactctggtgccaaatgactccaggaactgggccatgatgtggtgggaatgaccttaccctgagcatgtcactcatgcattgaacaacagctaagagcagagcttagagcttagagctgggccctgtaaggtgagaggaatcacatcctgcagaagtctgtcctgagaagcaggtactcctgtcacagcagagacacagtggatacctgagtaacaataatacaagacaggacgtgggmacagcaaaagatttgggtgtcagaagargccgagaacacttycaggcaggaacattcararttgttcttggaggaartaggcmcsaaggctgggcaggatttcmcggggcagagatggagcaagcaattgaaatgaaagccatggcatgggaaaaggagcactggccacagggagtgcaacgttgtgatgcaaggccactgtggagccat

SEQ ID NO: 39 - DNA, 812 bp, Homo sapiens
  SITE (794): n equals a,t,g, or c
  SITE (806): n equals a,t,g, or c
  SITE (810): n equals a,t,g, or c
ggcagaggctcaccccagcagagattgagggggaaccgtgatgaaatttttaagtattctgcttgatgataataattttyctcttatgttaatgttggctccgtttgggtgtttagcttttgaaaggagtatgaaaatgcggaatggggctttggggcttgaggaggtgtgatctctagtgtttaaaaaatttaattgcacaaatagaaataattcacccacattattgaaccccactaaagcatatcctttttgtccatattcctttcctgctgccctcgtgtgtaccattattactcagttgtgatttgagctcgttccacttaaagtcattcatagatacttttgcgtcgtgttkgaatatttattgaatttctattctgtgttttacttaattactttattatggaacctttacacaggtctggtgtacttgttctttgaaaagtcttatgttgaccaccatcactgagcatatagctttttccttatttccttgggataattacccgaagtggaaataccgaatcaaacttctgttttctttctttggcactattatataaattgttttccaaacaaggcatgtttacaatagacatttttcaaaatctgggtatttgtcctattttgctctctgtatgcagaattcagcggggtgccaagtcgttttctgtgtgggttgagagacaggctgtgcagcccactgttgcataggactaactactacaaatcatgctgagaccgagctatttttgctgcttagargctttgcagccttgagtaagtttcgncatctggaaacnttgnaa

SEQ ID NO: 40 - DNA, 1515 bp, Homo sapiens
  SITE (69): n equals a,t,g, or c
aattcggcacgagggaaattcaagcacttttcctaaaagaagggggaatggatgctgaaacaacacgtntcccacaaagggagcagacactgggcttgtgaagctgccccataccttccccacagaactggggtccggcctccctgacatgcagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggyctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggccttcactccgttaaaaaaaaaaaaaaaaaaaaaaaaaaaaaaaaaaaaa

SEQ ID NO: 41 - DNA, 704 bp, Homo sapiens
aagatggtggcgcccagagcttcgctctatgctgctcccctgagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttaaaaaaaaaaaaaaaaaaaaaaaaaaaaaaaaaaaa

SEQ ID NO: 42 - DNA, 1094 bp, Homo sapiens
  SITE (196): n equals a,t,g, or c
  SITE (226): n equals a,t,g, or c
  SITE (302): n equals a,t,g, or c
  SITE (596): n equals a,t,g, or c
  SITE (952): n equals a,t,g, or c
ggcagctttcttacaaacccatccttctgaaatgttgcttcaaattcatcctctgctccccagtcccactattccacacatactgttactgtttctttatcctactttctcaattttggaacatagttgcagttactgcattgaatacctgtgggtttgcctgttgttctgtctgtctctgtggttcttgtaatantggatcccagagataaaatggacagttgtnatgcacagttaattcagaaactagaccttacttgctgtgtgaaataccaactaaattctcagtgaactcagctganctttatctccttttgtttccccaatttataatttcagttcaggcccagaaagatggaatcccagctaagaaatacaagttacaccctgtactagcagcccatgtgtgcatgttctttaagtgctcttgcagctatgtcatttatattgatttccctgtattattataagcaaagcaaatttgaggaaaaaaacccataataccacacctcatttttttcaagtaatagggtcataagtctcatyctycatataatatgttgagtatgcagtatattatgtgttaggctctgganaggcagaggttagatcatgtwacagatcatatckgattaggcagataaacagtattttaaccttttccttattatatgtaacttgctttcaggttttttaatgttactattatgtctttaatatattatctttatttgtacttttgtatacagagtgattttccttttttaaaaaaaattgtgtctttaggatggattccaaagatgtggaatcagtaggtttaaggaatatggatattttggctggcaaggtggctcacacctgtaatcccagcactttgggaggctgaggtgggtggatcacctgaagtcaggagttcgagaccagcctgaccaacatggcgaaaccctgtttntactaaagacacacwwaaaattrgccagtggtggtggcatgtgcttgtagtcccacttagctactcgagaggctgaggcaggagaatcgcttgaacccgggaggcagaggttgcagtgaggcaagatggcacctctacactc

SEQ ID NO: 43 - DNA, 1821 bp, Homo sapiens
  SITE (1801): n equals a,t,g, or c
tggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcasctgaatgttgctggaaataaaaccttggtttgtmaaggctcytttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaggatgagtttgttgttttttgttttgttttgttttgkttttttaaagacggagtctcgctctgtcactcaggctggagtgcagtggtatgatcttggctcactgtaacctccgcctcccgggttcaagccattctcctgcctcagtctcctgagtagctgggattacaggtgcgtgccaccatgcctggctaatttttgtgtttttagtagagacagggtttcaccatgttggtcgggctggtctcaaactcctgacctcttgatccgcctgccttggcctcccaaagtgatgggattacagatgtgagccacccgtgccctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgaaaaaaaaaaaaaatttaaaaacycggggggggcccsgwaccccattngcccctaagggggggggttt

SEQ ID NO: 44 - DNA, 1024 bp, Homo sapiens
ggggcacagttgaagaagcgaccgagggactgggagtcgttagtgaggatgacgcggcatggcaagaactgcaccgcagggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccgsttcgcgggctccggagtgaagctgcaagcggagaaatcacggccggtgatgcaggcctgagtgtgtgcgggagaccaaataaaccggcttgggtgcgcaaaaaaaaaaaaaaaaaaaaaaaaaaaaaaaaaa

SEQ ID NO: 45 - DNA, 983 bp, Homo sapiens
  SITE (976): n equals a,t,g, or c
cgacacggctgcgagaagacgacagaagggcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaacttttgggccgggcccctccccacaataaagatgctctccgaccttcaaaaaaaaaaaaaaaaaaaaagrkgsggccggtccccantcccccc

SEQ ID NO: 46 - DNA, 2421 bp, Homo sapiens
ccggctgatcgctgccgctccgccaatacaatagagccakccactaccagcagcctggccctcttcctccttctccagagagaccaatccagccgaactcggggtttgcctgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtraccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagtttta

SEQ ID NO: 47 - DNA, 840 bp, Homo sapiens
ctcaaactcctgagctgaagcgatctacctgcctcagctaggattacaggtgtgagccaccgcacccaacctcaataagcktatttgataaaakatatgcaagctccctttatkcacttttcattcagaatgtttagtaatttgtattgtttttcagattttcagcccaatatatctccytgcccactgtgtcactgtattctacctawacatcatcacgtgtttctgctattggctgtatgatggaacactgcggctcattttcctgaaaactgccgatagtgcatagartgctgggatggaaaccagaarctttgaattcaagccttggttctgccttgtttttgcttgggtggccttgagtcagccacataccttttaaaatctcaatttattagaaattattccaaatcaaaatcaaatgagaaggtatatacaaaagtgctttatcccacaataaactattcaagagagagcaaaggagaggacatttactcaacacctcctaaaaggcagccagtgaaattaggcattttatttaatcctcctggcaactctgagagtaaagcattattaatcccattttggctgtttaaagaaattatttgcactagattccagctgtagtttagyttcagaaaaaaaaatcctgagatgtgaattcacagctttctgggtttaaagcccaagctctatcacatcatgctattattgttacattactgctagttctatgaaaagaaatactaatttatgaaatacatcttatccaaaaaaaaaaaaaaaaaactgggagggggggcccgtacccaaatcgccggatagtgatcgtaaacaatc

SEQ ID NO: 48 - DNA, 2432 bp, Homo sapiens
  SITE (593): n equals a,t,g, or c
  SITE (2049): n equals a,t,g, or c
ggcacgaggcccggaacgctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggastgctggtctccgtcctggaacagggcttgccaccctcccaccgtgtcatctggctgcagagtgtccgaatcctgtcccgggaccgcaactgcctggacccgttcaccagccgccagagcctgcaggcaytagcctgytatgytgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccanagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtaascctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggcggcccgagggcagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagcmantgtkttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaaaaaaaaaaaaaaaaaaaaaaaaa

SEQ ID NO: 49 - DNA, 1742 bp, Homo sapiens
  SITE (35): n equals a,t,g, or c
  SITE (570): n equals a,t,g, or c
gtcctgcaggagctgcacgcggccgaggtgcgcangaacaaggagcagcgagaagagatgtcgggctaagggcccggsacgrgsggcgcccatcctgcgacggaacacgttcgggttttggttttgtttcgttcacctctgtctagatgcaacttttgttcctcctcccccaccccagcccccagcttcatgcttctcttccgcactcagccgccctgccctgtcctcgtggtgagtcgctgaccacggcttcccctgcaggagccgccgggcgtgragacgcggtccctcggtgcagacaccaggccgggcgcggctgggtcccccgggggccctgtgagagaggtggyggtgaccgtggtaaacccagggcggtggcgtgggatcrcgggtccttacgctgggctgtctggtcagcacgtgcaggtcagggcaggtcctctgagccggcgcccctggccagcaggcgaggctacagtacctgctgtctttccagggggaaggggctccccatgaggraggggcgacgggggaggggggtgatggtgcctgggaagcctgcktgtgcanccggtgcttgttgaactggcaggcgggtgggtgggggctgcagctttccttaatgtggttgcacaggggtcctctragaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccgtgggacagccccgccgcccctccccaccagggctttgcagatgtccttgaaagacccaccctagagccctttggagtgctggcccctcctgtgccctctgccctggtggaagcggcascacaagtcctcctcagggagccccaagggggattttktgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagccacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaagaaaaaaaaaaaaaaaaaactgcg

SEQ ID NO: 50 - DNA, 1487 bp, Homo sapiens
  SITE (1486): n equals a,t,g, or c
ggcacgagcctccgcgaactgtggagtcggcggagggctggaatcagcgtgggctccaggtcgctggcagccgggtggcagaactcttccgaggctccttgggaagaagctacacccgagggagccggatgggcctcgaaaacctggcccgctctggttctgtaccattgcaaggggaaccgtaaactgagcttttctaacgtgggtttctgccaagtacttttccagctgcccccttccccccagcacacaggagagcctctgtgtagccagcgcttgacagtcgttaggtaggttgtactgtgtagggaggagctcaagatcatgaatggttgtcacaggagaaagcggttgcatctttgcaaaactatatacctgctgtggtttgtgttttcttttctgctgagtaatgaagttgtaagttcacactggcacattctcagggctgtgcagattatttgcactttatttcataggtgrataagtgctttttagctttctttgtatattgagttgcttttgaattgcttcccatatttttatttcatacaaactgaacaattgtggcccctctattttatttataaaggttcagtgtatctttgcctgcctacatcaatctgcaagggagttgcagaaagcctcatgttcatcgagccgtgagtcacaaccaatttctaagctgttataacaaaaaagtgtttgctttttttcacaagtaactttaaaagtgtagtttagaaagaaaacattttcaataaaaagacactacattaatcctggatgcttgcaaatcctaaaatmtattcctcctctagcgttgcacagctctgtgttgtatacacagactagctttaaaatttgtcacataccactttacctttacttttatgtatcattcccccgacttccttactgcaggtgtgggcaagaaaacttttcctttaacacttttcaacagcgggcataaaattctgcagctgaggtcttgaagaatgcagatgggtacagtatgtgttggagctcacagtgtgtattgactaacctagttccttttttgctttttttggtattgtcttgttaaaagtgactcccaggtagcaactctcttttttaagggtgggaacgaaagggacgtaggaagaatagatctagattatttaacagtcttcgatagagtttgaaagctttcttcttcattcaattttgggcaaaatactgcctctgcatttgttcataacaaaaagattagattaataagtagcttttgttggtggaaattaccagctctataagtcacccttggtggttcatggacctctgattagcttgggttttgcagtctcattgccacatgtatatgtggagccaatggccttttggtgctcagctgtttacgtctgactccttgacttctttggtacagtgatggagtcagatctcattaagtgtgattctccatggatataaccagccccaaaaaaang

SEQ ID NO: 51 - DNA, 1328 bp, Homo sapiens
ggcacgagctcgtgccgaattcggcacgagagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtcccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaaaaaaaaaaaaaaaaaactcga

SEQ ID NO: 52 - DNA, 1856 bp, Homo sapiens
gaattcggcacgagctctgcaacattgcaaatgaacttgcagccgagggttccgctgccccctagattaaattccccgggctgaaactgagttgcagatttacaatatcatattttaaattgctgtcttcaattaaaccatttatgaccataactaattttcaggatgtcgatgcatgcttttccaggccttccttctttgtacaaaagtaaatgtccataaagcgtttcacttatattcttcaaacatgatgctaatttaaattaattacttcctatgatatgttattattcctatgattttgccactgttattagttctctcaaaaatacatctagggaagaggattattttaagtratttgattatctttctatctcttttatttatttctcatttacttaagaaattcgttccattggttggcattgatacagtaaatttgtaaatgaggagacaatataaaaaatctaaattacttgtgcttaatgactgtagcagaatsccttttctctaaatcagattgtctttcttgcagtttagtttgatagatttgcaagctatgctgcttccatgaagttagctgcgctggtaggaacgcaggcttctttgtctctggttgtagcttgcatgatcgccccattaggcagacaacgtagccggagatcacaaatcaggcccttggtgtagttgctagtgtgtggaggtgcagagaggttggcagaaactgacctcactgggcaagggtggccatggacctgattctttaatgcactctatgtgttcaggaagccacaggccatatttgactctgagaaagaaaacaagaggaaaaaccccacaaagtataacaaccccttaagatacatctattttaaagtgaaattaatttttcagtttataccattggccaattacaagataaaaatgttcaatttctttaagaatcctttgttgacttgtcttttcatctcttgctatttatatttgtcactgttagtcaacaaagtcttatttgctgaggaaggactttgctgcacttactgtaccacatcaaacactggggagggtggtgtttaactttttaaaaaatgttattctgattataacaataatattggcttttttcatgaaaagagcgccaccttgcaaggtttagtgagatttatggaagttgaatacctaagcaggaattgctgctagctccaaaaatttgcgaagcaaaagctagccccaattggtttggaagtttgaaactgattaacagatttgcatttgaagtgactccagacattaggtccagacattagttaaaaatagaaagaggaataaagacatctyttctctctagaaaagataacaccrcaattaataatccttcccactttcattgagatcagcttgtctgataacctgatatgagtgtgataatgataaacatgataatagtggtacttttgtaattttgctggtgcatttaagaagatagtaaakgatgagttcaycttttctycgaacatycctatycctagatgtagtttacctcaaattgggaattataactgtcctaatttttgttgtgtaccctgatgccccttttgctttaatacccacagtgtaacaattaaatatcacactatgacatatgatttaagtaggatattttaaagataaattttaggggtaaatgtttacttcaaaatgactccatatttcaaatatctgtttagactgtgaaggccaaataatttttaagaaaacatttgaagagtagtgtgtttgcatttgtgaataatcttactcacagcaagtaaacgtaataaaagccaacatttaagccaaaaaaaaaaaaaaaa

SEQ ID NO: 53 - DNA, 1558 bp, Homo sapiens
  SITE (17): n equals a,t,g, or c
  SITE (1514): n equals a,t,g, or c
  SITE (1551): n equals a,t,g, or c
  SITE (1556): n equals a,t,g, or c
tgggtatccattcctgnaattactttacttaggataatggcctccagctccgtccaagttgctgcaaaaggtattatttcgttcctttttgtggctgagtagtattccatggtgtatatataccacattttctttatccactcattgcttgatgggcagttaggttggttccacatctttgcaattgtgagttgtgctgctccagatatcatctttaactcctttgccttctccacatacatttccaagtcctgttcattctacctccaaaatgtatcttgtatccattcatctctctccatcttcaatctatttcaatgccccatcatctcttgcatggaggagtgtaataattggctaactggcctgttcttacattttaaaatcaaaagatgtgacaggtgaaatgcctatttcagtgtccattgatggttctgcttacacaccacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaaaaaaaaaaaaaaaaaaaaaaaanaaaaaaaaaagggggccgctctagaggtccaagttangacgngg

SEQ ID NO: 54 - DNA, 948 bp, Homo sapiens
taaaaatcatgctctgtaccatcctcaccgtagtcatcatcatcgccgcgcagaccacgagaactactgggatccctaaaaacgcccctggtccggccccactctgcgcccctcgatctcccaggctctttctgcagwcataccgcggacccaatgggcgccctgcacacccgtttctggggccgtcagacttggatacatcgtaaactccgcctccacggaacgtctcgcctkgcgagcaagmtcggaatccagttcctcaggaacccctccaaaacccacacccccagggacgccgctttccgggatcccggscaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgcttcttttcttctccgcggggtgattcagtccagtgattgggtttgtggctccaggcctcgcccacagacggacagacccctccctttcttccggcaaaaggaccgagccctggggtagtaaggsccccacactcctgttttttgcaagtacatttttgtccytcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgaaaaaaaaaaaa

SEQ ID NO: 55 - DNA, 990 bp, Homo sapiens
  SITE (751): n equals a,t,g, or c
  SITE (879): n equals a,t,g, or c
  SITE (888): n equals a,t,g, or c
  SITE (897): n equals a,t,g, or c
  SITE (899): n equals a,t,g, or c
  SITE (901): n equals a,t,g, or c
ggggaactgcagtgacagcaggagtaagagtgggaggcaggacagagctgggacacaggtatggagagggggttcagcgagcctagagagggcagactatcagggtgccggcggtgagaatccagggagaggagcggaaacagaagaggggcagaagaccggggcacttgtgggttgcagagcccctcagccatgttgggagccaagccacactggctaccaggtcccctacacagtcccgggctgcccttggttctggtgcttctggccctgggggccgggtgggcccaggaggggtcagagcccgtcctgctggagggggagtgcctggtggtctgtgagcctggccgagctgctgcaggggggcccgggggagcagccctgggagaggcaccccctgggcgagtggcatttgytgcggtccgaagccaccaccatgagccagcaggggaaaccggcaatggcaccagtggggccatctacttcgaccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggnaatctactgggtggttggaaatactcaagtttctctggcttcctcatcttccctctctgaaggacccaagtctttcaagcacaagaatccagcccctgacaactttcttctgccctctcttgccccanaaacagcanaagcagganananactccctctggctcctatcccacctctttgcatgggaacctgtgccaaacacccaagtttaagaaaaaaataaaactgtggcatctcca

SEQ ID NO: 56 - DNA, 1603 bp, Homo sapiens
  SITE (328): n equals a,t,g, or c
  SITE (336): n equals a,t,g, or c
  SITE (341): n equals a,t,g, or c
  SITE (788): n equals a,t,g, or c
ggtcgacccacgcgtccggcccgccggctccggagcggctctgccttcccgagcgcgggaccgcgccctgggggaggagggcgaacgacgcggcgatggctccgcgggcactcccggggtccgccgtcctagccgctgctgtcttcgtgggaggcgccgtgagttcgccgctggtggctccggacaatgggagcagccgcacattgcactccagaacagagacgaccccgtcgcccagcaacgatactgggaatggacacccagaatatattgcatacgcgcttgtccctgtgttctttatcatgggtctctttggcgtcctcatttngccamctngcttnaagaagaaaggctatcgttgtacaacagaagcagagcaagatatcgaagaagaaaaaggttgaaaagwtagrattgaatgacagtgtgaatgaaaacagtgacactgttgggcaaatcgtccactacatcatgaaaaatgaagcgaatgctgatgtyttaaaggcgatggtagcagataacagcctgtatgatcctgaaagccccgtgacccccagcacaccagggagcccgccagtgagtcctgggctttgtcaccaggggggacgccagggaagcacgtctgtggccatcatctgcatacggtgggcggtgtwgtcgagagggatgtgtgtcatcggtgtaggcacaagcggtggcactttataaagcccactaacaagtccagagagagcagaccacggcgccaaggcgaggtcacggtcctttctgttggcagatttagagtnacaaaagtggagcacaagtcaaaccagaaggaacggagaagcctgatgtctgttagtggggctgaaaccgtcaatggggaggtgccggcaacacctgtgaagagagaacgcagtggcacagagtagcaggtgagccgtggttttggtgacattgggggcagagtggtgcagggtgaggagaaggtacttggagcctcccaggtgctgtggcagcataggaatggtatttgacagggaagtgggagagctttccttgacccaggaagactgagggggactgaacatgattacttgtctgcctagagcttcttgtaaagaagtcacaaacttagtgcctccaggggcttggctgtgtgataatgaggatagaggattacttgtgaggcaatgtggcatggtggggattgtggcaaactagaattcacatcacccaccatatagggcttgcattaccacgaggcagaaagcacctagtgttgctgcatcttcttacgcaaaaaagacaaaatccagacttctaaaatgtaaaatcactgattttcgatattggcagcttactttttttttttaaacaaccatgcaggccaaatgacttgtaatcttgtcaccatttttaggtaaactgtgacttgaaaaagtctggagcaaacaaaccaatgctttttccttttattctgttggraaccagttttctttgtgtcacagttytgaaacctcaatacgaatatttctcttcccaccaaatattttgaggcaattgaaaagccacagtgatttatttcttgatttggcaattttaattttgcaagacaatt

SEQ ID NO: 57 - DNA, 1052 bp, Homo sapiens
  SITE (250): n equals a,t,g, or c
  SITE (1051): n equals a,t,g, or c
  SITE (1052): n equals a,t,g, or c
tacagctcaggatgcctgtaacattgtcatctctgggcttctgggtcctgcttagcctgctttttccctggaggactgaccagggatgcggcccagcaacatgttactaaatcatactctcctccctacctttcccagacctctcactcctgcctggtgttccaacccgttctgtggccagagtatacattttggaacctcttcgaggccatcctgcagttccagatgaaccatagcgtgcttcagcagnaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccmctmyccttccttttcttggtgaaaggcacctcctttcctgataatgaatggtgttccctttgcttggctggggagccccccaggccaggtttgctggccatagatacctttgggctgcctgrgacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccactgctgctcctccccttggstytccacctgggatttgctattgaatctctaccctnn

SEQ ID NO: 58 - DNA, 814 bp, Homo sapiens
  SITE (3): n equals a,t,g, or c
  SITE (6): n equals a,t,g, or c
  SITE (32): n equals a,t,g, or c
  SITE (751): n equals a,t,g, or c
  SITE (770): n equals a,t,g, or c
  SITE (784): n equals a,t,g, or c
acncgntggcggccgctctagaactaggggancccccgggctgcaggaattcggcacgagcatagacttttaaactggtacggttcttagagatggtccttggccttctgttgttgttgtkgtttttttctttttcttcttctccttctccttcttcttctcttctccttctttcttcttttttttttcagagtcttgctctgtcaccaagactggagtgaagtgatgtgatctcggcttactgcaacctgggaggcagaggttgcagtgagtcgagatggtgccattgctctcgtttgggcaacaagagtgaaactcttgtctcaaaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgtatataaaagttgtatttaatcccttgtgccccaagaatgctataaaagatcccaagaatgttatctatgaaaagatagcaatagggaatggtgaacaaataatttaatttgccaattctaaaaaacatggacttaaaccccatgaaaacttggttccatagttttaactgttttatggttccaatacaaaaccagagtggtttacattccacaatnaccaaatttgcatccaatnttggggtaattttnggtatttgccatgggatactattcattttt

SEQ ID NO: 59 - DNA, 1215 bp, Homo sapiens
  SITE (345): n equals a,t,g, or c
  SITE (1024): n equals a,t,g, or c
  SITE (1098): n equals a,t,g, or c
  SITE (1186): n equals a,t,g, or c
agaggaagtcttttgccaagcctgttctctggactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaacaggcctgagcgatgggcatcacaccctctgcctacccacrtgcctgcttacctgccagataaccaagtgnagatgtctgcgagtggctagttttcacattcttactagtgtttggytcacctttgggcaaaggccccctctaggccttgccccacctccatcaaacgcagacactgtagtcagacctcagyaatataggaggcaataatcttttaacagtgttttgcaaacaaacaaaaagagaaaaatcccagccaggggaactcgccacctgcccacgctagttccatccacgctcaagacccgcccttagaccaggcaggcaaaggcccccatcacactcggccactagtggggtcctgaggccaagaaagaaaccagaccctgtatgacaagttgggktctttccagaacacgacagaaacagggggggccccttgttaatgccactccatactccagaagcattattccttatttgggacagccaagggcagattcacaggttattgtaggaataaagactagtttacaaaggaraaagagsccctggacttcccmaggaaaggtcaggttagggctcctgtacccattctgttccaccactgtttgatctctctggcctcccaccaggaatgccgtttcctttttatggatctgttgggaaccagagagaatcaacagatcaatgacataggatccgaagtgcaatgatagtcacttctagtttggcatttcacaaactctgnacagcaaggtattggtaggttactcaatttcaaaagggccccatggccaaatatgtttaggaaccgctgtttgnatttctttttttggagacgcattgtatataatatatgtcaaaggctttcggaattcctgcaggaaagaaatcagctttgttaaatccnaaaaaaaaaaaaaaaaaaaaatagactcg

SEQ ID NO: 60 - DNA, 478 bp, Homo sapiens
  SITE (410): n equals a,t,g, or c
  SITE (476): n equals a,t,g, or c
atttcttatgacatgggggtttgaattggttggcaaatgtttaattttaatatccataatcagtgaggtcctgctggctgtaatcattaattgtgaaatctaaggagcttagttcatggctctagaatttcacagaaaartgygmtatgatacgagcattaagtttatttcttctgatctttgatgcagctttgttcagtttatctgtttttgtatttattggtcatctacttcccatgccaaaagggactggtctacatagctgcgctaaacacctgatcaaatcactaaaagaaaatgtgttacctctaatgaattatcctgattgtaagttaaaaatcaatatttccccgtagtgaggtttgctttttaaaaagaakkcttaaaaaaaaaaaaaaaaaaacgagttnaagaaaaggaagcaagctcaggtaaggtgcacacattgggctaaggaagctagagcctgtggagangc

SEQ ID NO: 61 - DNA, 618 bp, Homo sapiens
  SITE (24): n equals a,t,g, or c
  SITE (39): n equals a,t,g, or c
  SITE (548): n equals a,t,g, or c
  SITE (560): n equals a,t,g, or c
  SITE (562): n equals a,t,g, or c
  SITE (584): n equals a,t,g, or c
tatgaccttgataaccccaagttngaaattaaccttcantaaagggaacaaaagctggagttcgcgcgcttgcagttcgacactagtggatcccaaagaattcggcacgagtcataatgagctactaggtaagccttctgggactttcagatattttggggaagattgatttttgttcttacatgctgtggacccttggccatcaaatggtatggggaagctcatccgtctgtctgtgatggtcatgtcagtcaggcgtctttttagtatttactgggtgctcagtactgtgccagatgctgtcgggagccgtggtggtatggaggaggagtgctccagaggactctgctgtgtggcaggccagcataaacaagccaaggggaaaaggcaggcatggaataaagggggagaataccagtgtgtgacttactgctgactgtgtggattagcctatcagcagtaatcaagcagggcggagggcattatctttgagccagaagagtgagcactggsccgagggtggagcatcaagagggggtgtaggaccncaaggcttcttncnggggagacaacgtcaataagcngtcagtagtcaccgacagttttgggaagcaaggg

SEQ ID NO: 62 - DNA, 751 bp, Homo sapiens
  SITE (158): n equals a,t,g, or c
  SITE (159): n equals a,t,g, or c
  SITE (202): n equals a,t,g, or c
tcgacccacgcgtccgaggagctggacttctgagacagccattctccttgcatagcactgtctgctgctacagctcatagaagtcaacaattttcttcaacactggtaggcagcctctaaatggccctgatcaccctcacctcctgccattcacaccnntgtaaaattccacccctggacctagtgactcacttctaacaangagaatacagcaaaagtaacatcgcttctgaggtgaggctacaaggagactacgatgcctgccttggtcacccttctcctgctctttccattgctccctctgatggaagccagttgccatgtgatgaggtgccctatggagaggcccacgtgacaaggtattgtaaaaagcctctgaccaatagccatctagaaacggaggcccagtccagcagcctctgagatgaatcctgccaacctgagcttggagacagattctctccctatcctgccttgggatgatcacagccaccaccaacaccttcactgcctggtgagaggccaagccagtgaacccaaggtaaactggacagaatcctgacccacagaaactgagataatgtttgttattttaagctgctcagtttgttacagagcaatagataactaactcaaacaccataaaattctaatattttattctatcacacaaaccaggtaataccaagtaaatgccattactatacacatatttttgtaacacaattacatgtgattttttaagaaggct

SEQ ID NO: 63 - DNA, 780 bp, Homo sapiens
  SITE (2): n equals a,t,g, or c
  SITE (4): n equals a,t,g, or c
  SITE (12): n equals a,t,g, or c
  SITE (738): n equals a,t,g, or c
  SITE (776): n equals a,t,g, or c
cngncagtcacngtccccgattcccgggtcgacccacgcgtccgggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgccaaaaaaaaaaaaaaaaaaaccgcggccgaaagcttattnccctttaagtaaggggttaatttttagcttgggcactnggcc

SEQ ID NO: 64 - DNA, 588 bp, Homo sapiens
  SITE (565): n equals a,t,g, or c
  SITE (566): n equals a,t,g, or c
ttccgaattaatcgactcactataggaawtgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccaaaaaaaaaaaaaaaaaaaaaaaaaaaaaaaaaaaaaaaaaaaaaaaaaaaaaaaaaaaaaaaaaaaaaaanncgggggggggcccccccccccc

SEQ ID NO: 65 - DNA, 945 bp, Homo sapiens
  SITE (1): n equals a,t,g, or c
  SITE (13): n equals a,t,g, or c
  SITE (15): n equals a,t,g, or c
naatacgatcatnanagggcgattgggtacgggccccccctcgagttttttttttttttttttggcaagtgagaagatgcagataggcaaaaagraaaaaaaagagatcacacagagattcactgttaacctttggtgtataataaaatcagacactttcctttgcattatgtcacatagaaatgtacaaataaagtgtacatatatacacacatatatgtatacactgttttgcaactcgttattttcactttgcaatatacaatgagcatttttccatgcaaatgaatgagacctcttattaaatgaataagattgggtcaaaagatgagatgttgacaagagtcatatgtaaatctcagcaacatcgaatgactggagtaaaacgatagcaaatatttatcaagaaagtgcagacaaacagaaagcagtggcaacattaataacagaaaataattgaattgtcagagaaattaattaaatgggataaggacggtcccgagaatgcctatggttagaatgcagagccctaaatttctttctyagaccccttatctcttccaaacacctttccatctcatctccctcccttgtcatttcttcatctttaaaatgcctatagtctatgtcctctttaaattcttcgagagactgaagcagcctctgtctaaaattcccttctgtttgctggcgttcaaattctccatacgggcgtttttcctccctctttggcacgctgcactttggctttccttcgttttctttgcagggtttttgcatgatgttgttgttgtttcctgcttaactctgtgcggggtagtttcctgctccttttcttcccccagatgtctgtgaacacagatcctgggacctcttccttcccttggccacaagcacgcacggcacgcttgtctgcagggcagtaaggagctggtacctcgtgcc

SEQ ID NO: 66 - DNA, 1866 bp, Homo sapiens
  SITE (262): n equals a,t,g, or c
  SITE (674): n equals a,t,g, or c
acccacgcgtccggtcctcttcttcagcacatgccaaagctgttcctcacggcctgtgagacaagagcatcttggatgtaggacaatggaagagttagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcantcgtgtatactaccaatatccaggagctcaatgtctacagtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctsgagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggnctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataaaaaaaaaaaaaaaaaaaaaaaaaaaaaaaaaaaaaaaa

SEQ ID NO: 67 - DNA, 1152 bp, Homo sapiens
  SITE (668): n equals a,t,g, or c
  SITE (745): n equals a,t,g, or c
  SITE (1015): n equals a,t,g, or c
  SITE (1088): n equals a,t,g, or c
  SITE (1110): n equals a,t,g, or c
  SITE (1113): n equals a,t,g, or c
ctcaaggatgtaaaggctctgcagatttcgggaggcctgtctcccagcacctgatgggacactttttgccccactgtaaattctgggtgtatcctccactgtatgctgtcaccccaagggcaagcactgcatctgcttagtgaaggatttattgttcggaagatacattttccccttkagcagagagtggcgtatcctggcagtcttcggtgagccagttgtaccaggattatgaaatgcagatgtttactgtgtcattgttgctgtcattgctactgaggagtactgaccagaatcatctgcaactyttagttggcagagaggaccactatggcgggtagctcttttctttcctgccattgtggggatgattccaggccaaagatgatggaraagtatggaaatcatctgaaaggttgaagcttggcacgtgaagccattcatgactttgtaaggcagttttgctgaaggccagttctgccctgggagggacggaggtgaatcctcctgagtacctgtggttttcttacttcctgctgaatttacctaagtgcctgttgtttgcttgctgtggaggctttctggtatttcatttcaggtgcagatgccttcactttcccaccraaaaaaccccmaccaaacctaagaccttactgcaactaagtytnccaagtactttttaacccaatgggatgaacagcctgtggtctgctcagatcaccctgagtgcgtgtgagaaggcmtnggctttgccaggaaatccaggaaggcagggccgggctgtgttggaagctggcttagctggtggggcagccttatttcaattaaaagggcattgactgggagcagcagtcctggagtttgttgcatttcctattgccctcaaaatgagaaaccaggaaaatagcagattggagccttcgagaaggcagtaaatggctgtttttattgacaaaaggaaaacattttactgccatctcactgatggcatctcactgacttaaaatgaaggcangttgtagtaaaaaaaaaagtctacatttttccaccgccacgttcttatatcctgtttgtcagccactgctcanaagggcatgttgtcttgcggantanaggcgctctccttccctcgttttccctataggttgggtg

SEQ ID NO: 68 - DNA, 2483 bp, Homo sapiens
agcaggcggtgcgctgggggcgggagcagcgcgkagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaascaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataaaaaaaaaaaaaaaaaaaaaaaaaaaaaaaaaaaaaaaaaaaaaaaaaaaaaaaaaaaaa

SEQ ID NO: 69 - DNA, 536 bp, Homo sapiens
gagaaatggagctttgttagataaaaattttttcaacgcaaacagtcattttccagtgaaaggagagcgtatccgccgtaggatggacttagatcgtgtaaaagctgaggccaccgaggatataacctccggggtcctttgcctccttttccttagactccctccaaactcgtgtatctttccttcagcagtactgggctccacgcgaacctagtcctttgtctttaccctattacctttcataacatcctagttgaaaagtarttattcaaccgcgtttgaaaatgagaacaggttcacagargctaggttacttgcgaaggtcgttcaattagtaaccagtaacgccaggactgccagtttcttgcttccgaattctcatggtagctttcaccargctccccgtcmaatgctaacgtcaactactgaactagattagcaaaaaggtcttttaacagaattcctggttttcagagagagtttctttcatgaagcgccccatttctacagaggaaaataaactccaagcagccagt

SEQ ID NO: 70 - DNA, 574 bp, Homo sapiens
ggggggcgaattcccctggcacgaggctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtaaaaaaaaaaaaaaaaaaaaa

SEQ ID NO: 71 - DNA, 932 bp, Homo sapiens
  SITE (884): n equals a,t,g, or c
tcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaaacatagagaatggtggataattacaactgcacaaaaataaaaattccaagctgtggatgaccaatgtataaaaatgactcatcaaattatccaattattaactactagacaaaaagtattttaaatcagtttttctgtttatgctataggaactgtagataataaggtaaaattatgtatcatatagatatactatgtttttctatgtgaaatagttctgtcaaaaatagtattgcagatatttggaaagtaattggtttctcaggagtgatatcactgcacccaaggaaagattttctttctaacacgagaagtatatgaatgtcctgaaggaaaccactggcttgatatttctgtgactcgtgttgcctttgaaactagtcccctaccacctcggtaatgagctccattacagaaagtggaacataagagaatgaaggggcagaatatcaaacagtgaaaagggaatgataagatgtattttgaatgaactgttttttctgtagactagctgagaaattgttgacataaaataaagaattgaagaaacacattttaccatttaaaaaaaaaaaaaaactngaggggggcccggtacccaaatcgccgcatagtgatcgtaaacaatct

SEQ ID NO: 72 - DNA, 996 bp, Homo sapiens
  SITE (584): n equals a,t,g, or c
cgcctggcaccatgaggacgcctgggcctctgcctgtgctgctgctgctcctggcgggagcccccgccgcgcggcccactcccccgacctgctactcccgcatgcgggccctgagccaggagatcacccgcgacttcaacctcctgcaggtctcggagccctcggagccatgtgtgagatacctgcccaggctgtacctggacatacacaattactgtgtgctggacaagctgcgggactttgtggcctcgcccccgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccnggaacctcctttgagcatagagttagcaaccatgcttctcattcccttgactcatgtcttgccaggatggttagatacacagcatgttgatttggtcacctaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttaygtagtgctgacaggacccactctttcattgaaaggtgatgaaaatcaaataaagaatctcttcacatgaraaaaaaaaaaa

SEQ ID NO: 73 - DNA, 785 bp, Homo sapiens
ggcacgaggggctttgcgtacacaatagctgctaggagtacccaaagcctgartacarcctgctggtgtcatggccacgtgtgagcaggccagcgtcamacggctcgctgtgacccgtcccgragactgaaatgggcctgggtcttctcctkgtcctgtgatwaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacrtcttggtgcttctctttcccagaggctggtcccagccaggcacacacaaaaggcagattctcgtaaacscagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgtaaaaaaaaaaaaaaaaaaaaaaaaaaaaaaaaaaaaaaaa

SEQ ID NO: 74 - DNA, 1069 bp, Homo sapiens
  SITE (20): n equals a,t,g, or c
  SITE (92): n equals a,t,g, or c
  SITE (886): n equals a,t,g, or c
tcctcaccattcccctaggncaggtccctgcaggtcccacacttctcccaggtccctaaacttgggtcggtcctttccctggagtagctggntcctccagtcgaggtccctgttcagtcggttcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagartacaagcccagcaccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggnactccgtggtggtcctgcccttctccctgcatgcctgtgggtctgctctggtgtgtgaaggtcggtgggttaactgtgtgcctactgaacctggcaaataaacatcaccctgcaaagccaaaaaaaaaaaaaaaaaaaaaaaaaaaaaaaaaaaaaaaaaaaaaaaaaaaaaaaaaaaaaaaa

SEQ ID NO: 75 - DNA, 831 bp, Homo sapiens
ggacattagatcactgtggacctaaaacaaacaaacaactataaggaaaatggcattagaaatggtctggggatcagtttatcactgcagttgttacatcaccccatggtctaaaatacagagctttagtctgtctctgtttcagttcattttacaggaggtgaacatcacacttccagaaaactctgtctggtatgaaaggtataaatttgatattcctgtctttcacttgaatggccagtttctgatgatgcatcgagtaaacacctcaaaacttgaaaaacagctcctgaaacttgagcagcaaagtactggargctgactgatgccctcatgattttccaccctctcttcccataaagcatcttcctaaggaaatgamcatggcctgatactcattttgtcacttgtacagagccctaaggatgttctgaattcagtggtgccaaataaatgttgacattccccttttggttgatggaagtatcagtgtgggaactgtttgcttaatggcattttataaaataakaakakcatattagcagggagggagatgatggagggagggagaagtccatttgtcttatttatcctttttgtattaatagagaagcacttcacagtcactggcaatgccatttataggaagaaggttctgcattcctgctgctcccggagggcttaactttttaatgaaagaataaatgctcttccactcagtagataaagtgaaatgtgaattgttaataactgtgcacggtcaataaagcgatgttttaaggaatacaaaaaaaaaaaaaaaaaaaaaaaaaaaaaaaaaaaaaaactcga

SEQ ID NO: 76 - DNA, 590 bp, Homo sapiens
  SITE (12): n equals a,t,g, or c
  SITE (27): n equals a,t,g, or c
  SITE (30): n equals a,t,g, or c
  SITE (35): n equals a,t,g, or c
  SITE (76): n equals a,t,g, or c
tatatatagacngttaatagtcgtgantgntgtgnacgaacattaacggaagtagcatgtagccagtcgaataacntataaggacaaagtggagtccacgcgtgcggccgtctagactagtggatcccccggctgcaggattcggcacgagctgccaggtgaggagcagagagactgttcccttgggtggagaggtgtgggcatgagagccacccattgccaagcagcaagaatgttcgtgcttttttcccttccaaaatatgcagggctcaggctcccaattccgggcctgtctgctttgcttgtgtttctcctgtccctgttctcccggagggcccaggtggaactcacgacagggagggagacgcttcccaaaaacctgcagggctatttcccagaatttggttttcaagtacaaaactttttgtcctgtaagatatatgcagcctcacagaagcagcctctgcctccactttaccagctacgtttttatcttaagcacatggggctcccttagaacttactccactgatttaaaaaaaaaaaaaaaaaactcgagggggggcccggtacccattcgccctaaaagt

SEQ ID NO: 77 - DNA, 1274 bp, Homo sapiens
gagccaccacacctggcctggaaggaacctcttaaaatcagtttacgtcttgtattttgttctgtgatggaggacactggagagagttgctattccagtcaatcatgtcgagtcactggactctgaaaatcctattggttcctttattttatttgagtttagagttcccttctgggtttgtattatgtctggcaaatgacctgggttatcacttttcctccagggttagatcatagatcttggaaactccttagagagcattttgctcctaccaaggatcagatactggagccccacataatagatttcatttcactctagcctacatagagctttctgttgctgtctcttgccatgcacttgtgcggtgattacacacttgacagtaccaggagacaaatgacttacagatcccccgacatgcctcttccccttggcaagctcagttgccctgatagtagcatgtttctgtttctgatgtaccttttttctcttcttctttgcatcagccaattcccagaatttccccaggcaatttgtagaggacctttttggggtcctatatgagccatgtcctcaaagcttttaaacctccttgctctcctacaatattcagtacatgaccactgtcatcctagaaggcttctgaaaagaggggcaagagccactctgcgccacaaaggttggggtccatcttctctccgaggttgtgaaagttttcaaattgtactaataggstggggccctgacttggctgtgggctttgggaggggtaagctgctttctagatctctcccagtgaggcatggaggtgtttctgaattttgtctacctcacagggatgttgtgaggcttgaaaaggtcaaaaaatgatggccccttgagctctttgtaagaaaggtagatgaaatatcggatgtaatctgaaaaaaagataaaatgtgacttcccctgctctgtgcagcagtcgggctggatgctctgtggcctttcttgggtcctcatgccaccccacagctcccaggaaccttgaagccaatctgggggactttcagatgtttgacaaagaggtaccaggcaaacttcctgctacacatgccctgaatgaattgctaaatttcaaaggaaatggaccctgcttttaaggatgtacaaaagtatgtctgcatcgatgtctgtactgtaaatttctaatttatcactgtacaaagaaaaccccttgctatttaattttgtattaaaggaaaataaagttttgtttgttaaaaaaaaaa

SEQ ID NO: 78 - DNA, 1133 bp, Homo sapiens
aggatttttccttgttcaaccaaaatctgagcattctttctatgttgaaaacactgaaaaactaatttwagttaatgaactagaaagaatattgattttwaagaaacagaaaaatactacttattttccttctcaaataacgtttctttcaaaaacttctggctgaagtataacatgctggtagttaacataaatcttgtctttctcttgttctttatctttctttgttatttagatgcttgtataaatgtcttttgtttttattaagtgcctaattgacagagcttaatttgaagaagtgccctaatttattgaccacttaagaattgcctttattggggtattttatttgttcctgcgtctttttgatgttgttcagtctactcatccctgtgagtatgtgtgggggacagctgatagaagggaggagagtgtgtctatgctcaggattgccctttagccactcagccagagatccacagggagcaacaaggacagtttcacatgcttagactttcttggaagaaacagtgaggaggagtaagtcgtgagtagtgtcaagctggatgtagaattgtcctaaggcagttgaccccaccttccaacatgttttcactttatttgcccctccctacatttgggttaggttccatttggatttgcagcaataatgactttatttctctcttggtcaggatttggcacataaaatccttttattatagaactagctattttagttacatagtaatgtaactaatggagagatttatagagaattttgkttttgctgtcatatatgtccattttggagacagatatgatagaactagaaattaagttgcatttctgcaagtgccatttgaatgaacttcaagtatcttcttaattattaaattttctgatgaaggcattgtaacaaatatatagtattattaaatctaattaatatttggaaatattaataaataggtattttatttactgtaaaaagtcaaacttcattatgtagataaatcttattcttttcattctttcccctgtttacatcctttttacaaagcttagtcaccaattaaagctttcctatcaaaaaaaaaaaaaaaaaaaactcgagactagttctctctcct

SEQ ID NO: 79 - DNA, 661 bp, Homo sapiens
gaattcggcacgaggggaaaaggatgctgaacgagagcagaaagcctctttcctttgcttcacgcctttccagtctttattttaaactcgggttccctttctgtggtcgcagcaacctttactccacctgcactgctgctcctgggggctccccaggcctccctctgcctttctacccagtggctgacgggatgcctgtcttgcctggacgcaccactgctctcctgtccctcaccttggcttttgctgtgccctgctctggggttgaagctggcccatgtgtcccccggagtcatggctgctcctcctgggaggcctctgtgtgcgtcacgtcttccacacctgggggcagctggcgagcccgtgctctgttcccctcggctgcttggcacagagytgcagcctgggaytctccgtggacccagactggggattttgccaggggggcgatgggaggagcaggtgctttgcctggcggctgtgtctgcatttctggacgccccagagcacagaagttgccggcactttgaggtcttcctcggcatgtgccagattacatgagtgacggctgggaatatgttttcttttttgtaatggaggcgtgtttcacatatagtaaagctcaccaaaaagtaaaaaaaaaaaaaaaaaaaaaactcga

SEQ ID NO: 80 - DNA, 1378 bp, Homo sapiens
agacgtgaaacatgtgaacactcaagtgaagcaaaagccttccatgattacccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggycctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaaaaaaaaaaaaaaaacttcgagggggggcccggtacccaat

SEQ ID NO: 81 - DNA, 1440 bp, Homo sapiens
  SITE (38): n equals a,t,g, or c
  SITE (41): n equals a,t,g, or c
  SITE (1128): n equals a,t,g, or c
  SITE (1129): n equals a,t,g, or c
  SITE (1440): n equals a,t,g, or c
actttgtccaaatgtgtctgtcacatgtagtcagctgnagnaatttaaaatgaattgccaagtgaagagtctgtggattaattggccgttaattaacaggctttatcaatgtgtcctcaagggagaggcccaaccctaattaaggagctaaacttcctgagtgaggggctgtgaggatggaggtggaggaggcatctggggcgggtggtggccgggccagcagatggcgcctccctggctgagctgcccgcaccgccagttccctcatttccactcaggaaggcagagaaggcagagtgatctcctcaaggaagagcttccccagccttcgggagcagctggcagggcgtccgggaataagccctacacgccgccgcctgcctccaactcactaaccctgcgcctcttgtctttcagattcaacgcgttcaacagaagccatccccagcccagcttaaattataaagatagacaataactctgttccaatctgcgtggtgcttctttagtaaatactgtacagattttaccatggagaactttttttttagtttttaccttttcttaattacccttattccgaatggacgaacactttctaccactgctgaccattgtaaaataccgtgtatataaatcccattgaaataatgccctggaatagaacatctcaaatgctgcttaattacagactcaggtcgattacttgtatttcatgtaatgttcctccaagttagacatctggtgcaagaccaaccgggagaccatggaattgtcaaaagtacaaactgacagtgtgtatatttaatttaaagacttatttaaaaactcacaagctctcacctagactttggagagcagtctgttttctgtaatgtctgatactagaaactaatttgcttattttagttgtattcaagatttgaagatgtattttatagacaagttctgtttttgaactttgtggaactgttccaatcaatcaatttcccagttatgatgagtatttacattatgaatgtataacccagacatgatttgtaaagccgacagtatgtttctattacacaacactttttgatacagcgtctcttgtcttcactgatactggagtctccgttgtctgcnnggtcccttcgagtttctagttacagacacaatcatactgtgattttatttttaatatggatatgctatcaaactgtgatacacttataattcactggtcctgcatcaggagatggagtggggaaaactgtatttaatacagtttgtatctgaataatctgtatggtttatacagtttgtgttgttcagagatgtttaaagtttgatctttgtttttctaaagattaaaaaagcacttgccccactgtaaatatacagcatgtaaaatttctrtagtatataaatggcagcaaatcacaaaaaaaaaaaaan

SEQ ID NO: 82 - DNA, 1381 bp, Homo sapiens
  SITE (1379): n equals a,t,g, or c
cccgggctgcaggaattcgkyacgaggccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagcacttcagtccatctgccctccagaggagggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaaaaaaaaaaaaaaaaatntc

SEQ ID NO: 83 - DNA, 1706 bp, Homo sapiens
actgcaccactgcccaggtctcccggctggatgaagacgtggtccatgaggaagctggctagctcagactggagagtagcttcaggaaaaaagacaagtggcctaaggaaatcacggcccccaactatcatctgagggctaaagatgagaagtagatcacttaataagacaaaagcctgtagggggaaaagaaaggatgtttaaaaggacagaatgtttcccaaggtagaaatgacactgtcaatttctccttggaatgggggcagggatactcgccttgttgctcccacttgagtcagtactcacctgctcctggatctcagtatccacatctgagaggcaactctggcagagttcacagaaggccaccattctgtccctcaaactcgacagctgcttctgtgggcacagtggcttgaaggggaagaatgaagacacagactcctctgttcccattatcccatctaagacccacactcacctggggaagcatctgatttagaaatgtgggttagtgtccagagaatggaaaaatagacaagagtcaaggctggcaggataacctgtaacaacaaagggtttgaaaaatgaggtttgggttaggagagggagagacagatagccagaaacacaccagtgaagaggagagaaaatgagtaaagggagagctaattccttttccagtggaaaatgagtgatattctggacattcttcagaggcatctacacgaagtagaaatgtcaccgctccctaatttactctacgtcttctagaatccctcaatattatccttggcttccaggaaatccaagaagaccctggaagtagagtccaccttctaagagaggaatgtaagaggtgacccccacccacctgatcttcctcgctttgtccactccacgcactgagacttgacacacctagtggccacctagaacgtaggtccttaaaatytagccccccagcccccaacccatctctagcctgtccactcacctggtgaggaacytytcctgtgtccacagcyttctgcaggagttggcaacatggctcatagagctcccagcgagtcaggtcatgagtgctttgggggagaaaggggaatgttatactggaaaagaacagagggaaccaactccacagacaccagtaaaaacgggatggggaagaggaggaaagccactcacttgtagaaggcagagaggcgtttcagagtggctgccagattatatacctcatcctcatctaggaaggacgactgagaaggaaagaagatccacaatagcatttcccccagaactcatcagtccacatcccccgtcttgcagcccctcccacccttgtttggggtgtcccattgtccagccccagctcctacctgtaacagctcttcaagctcctgctggaarcggtcagtcagcaaatctactagctggctgcgggcaaagtccgcccggctgaagaaagtgaattcgggattacagagcaggtaagagcatgcgccccagcctcaagcaccgctggctctgcatgcttcaccaccacctcctggagttgctgcaggaacagctccaggtgctgagaagaaaaggcagaagatggtgtgctgtggggatgggaggaggacactcttctggcgggaagtggaacggggttaaaagcattaaacttcaaggataagatgcctaaraaaaaaaaaaaaaaa

SEQ ID NO: 84 - DNA, 573 bp, Homo sapiens
gaattcggcacgagcttggtagccttagaactgcatgagctgctttaccactgggaaacacgagcacagcctagcttgattttgtatgtggtatcagatctaaggtggatggaattcaggacttcctgtctactctttgattttgttttatttttagaaatgttttattttgttttattcatttattcatcttcagagacatggtctggctctgttgcccaggatggagtgcatggtgtgatcataggccactgcagtgttgagctcccgggctcaggcgatcctcctgcctcagctyccttagtagctgggactataggcacatgccctaccatgcctggctttgtctactttttgaatgatgtcycaaactagaaggtctattaatttaaaaaattaaggatagcatgccataattaaaaataataacagtgggaaaaggcaccttccaatgattcagacatcaacttgtgatttaaaaaaacgaaaaataaataataggaaaaaaaggggaaaaagttaaataaaaataaaattaaaaaaaaaaaaaaaaaactcgaggggggcccggta

SEQ ID NO: 85 - DNA, 684 bp, Homo sapiens
ctctttggctgtgtctacctccttcatctgctgcgccgacataagcaccgccctgcccctaggctccagccgtcccgcaccagcccccaggcaccgagagcacgagcatgggcaccaagccaggcctcccaggctgctctycacgtcccttatgccactatcaacaccagctgcygcccagctactttggacacagctcacccccatggggggccgtcctggtgggcgtcactccccacccacgctgcacaccggccccagggccctgccgcctgggcctccacacccatccctgcacgtggcagctttgtctctgttgagaatggactctacgctcaggcaggggagargcctcctcacactggtcccggcctcactcttttccctgaccctcgggggcccagggccatggaaggacccttaggagttcgatgagagagaccatgaggccactgggctttccccctcccaggcctcctgggtgtcatccccttactttaattcttgggcctccaataagtgtcccataggtgtctggccaggcccacctgctgcggatgtggtctgtgtgcgtgtgtgggcacaggtgtgagtgtgtgagtgacagttaccccatttcagtcatttcctgctgcaactaagtcagcaacacagtttctctgaaaaaaaaaaaaaaaaaaaaac

SEQ ID NO: 86 - DNA, 1036 bp, Homo sapiens
  SITE (1020): n equals a,t,g, or c
  SITE (1024): n equals a,t,g, or c
  SITE (1032): n equals a,t,g, or c
tggaggcagatgcacaggagaaaggttcccgtccgcaccctctcagacctgaggctgagcttgcagtgagggcttctcctcggcccctcgcccgcccccagagctgccatccctgctgttacaagccagaggagcccggatgtgaggccccagatcacctccagggacttggggttcccatctgaaatcctttatttttgtaccatggggtgggccccgggctgagaaggaagaagcaccctctccccggcctcctctgtctgcacccgtggggctgtgacttactcctgcctccaggggcggggcggggccccctgggacctcttaaggcccaaggtgggccccaggacctytgggcagagtggaytgctcatggcagatgtgtggcaatgtctggctgwgtctttccggcamctgcgtyccctytcccgggytcccctgctgcatggtggatgtgctccttcctggcccggtcacattgcctccttgagccttagtccagggggtcactyctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagcaaaaaaaaaaaaaaaaaaaaaaaaaaaaaaaaaaaaaaaaaaancccngggggggncccg

SEQ ID NO: 87 - DNA, 908 bp, Homo sapiens
  SITE (805): n equals a,t,g, or c
ttaaacaaatggaatcatgcaatatgtgaccttttgcgtctggcttattttatttagcataatgtttttgaggttcatccaagctgtagcatgtatcagcacctcatttctttttctggctgaatattattccattatatggatttaccacaattcatttacctattcatcttttgtttctgctgtctggctattgtgaataatgcttcgataaacattcatatacaagtttctatgtggctttatgttttcatttctcttggctatctacatgggagtagaattctaggtcataatataattttatgtttaacttctcaaagaattgccaaaaggtttttcatagtggctgcatcatttacattcccaccggcaatgtacaaggatttctatttttccatatccttgcacttaccaacacttctttttkgtwatwattttgttttttcattattgccaccctagtggatgtgaaatggcatcttattgttttgatttgcatttctctaatgacaaatgatatcatactttttttatgtgcttacggatcaaaggtatttccttggagaaatgtcccttcaagtcctttgccatttcaaaatttggttatttgtcttttattattcagttttaagaaattctggccaggcgcagtggctcacctgtaatcmtagcactttgggaggccaaggcgggcagatcacttgagktcaggacttcgagaccagcctggccaacatggtgaaaccccatcttactaaaaatacaaaaattagctgggcgtggtggcaggtgcatgtaatcntatctactcaggaggctgaggcaggagaatcgcttgaacccaggaggcggaggctgcagtgagccaagatcacgccattgcactctagcctgggtgacacaga

SEQ ID NO: 88 - DNA, 655 bp, Homo sapiens
tgcactggttccttctccccagcaaatactgccttcttgtttttctctgatgtggcaggtgactacaaaatccgccttggtattcttcaaatgcatatatattcctttcttgtcagctccctctcttcctagattagaaaactgcctcattttctgctcactggatgtgcagtcccagcttgtcttcctctcctccccccctgttgcaggtgttctttttttttttcttctctccccactgggcagcaaaagttgttccacagtggaaawttaggcatcctcaagtttcytcccagcttctgctgtgttttcttagagtaaattgccaatttctgtttttacaggaaatccttttttaaaaatggaatcagtgtggtccccatctactctgcaaaaattgcatttttctctattttcaaatgagatttgttcaagtttcaaaaccacgtgaaataataaatgtatagtagttttcttttccttgggcattgctwgatatgtgaaatgggtttatgaaaaataataaaatcataacgctatttgtttgactttcaatttcatgggaatttttctcagctaaactctaaatggtgattargcaaaaaaaaaaaaaaaaaacygraggggggcccggtaccaattcgccctataatga

SEQ ID NO: 89 - DNA, 1102 bp, Homo sapiens
ttttttttttaccatttaaaataaaatgaaagtgaccttctgtttataaaaatctttgtctgcatctctgcttatttccttagaagagattccaagaagcggtgagtgatttcacggcagcagagggttgggacatattacgggcgcggatccctcttggagtgagatgactctccggagagatttagtcgtcaccctcgcgtgtgaggctgcgtcacaccccagggatgtgtctatcaagatggaagatcttttacacgctcttgattttgtttgcctttttttctattactagtgagaatgaaactttttatatgattattatccatcataatccaacacaaattactgcttcatgttcttttactttcctgtgaaggttttagtgccttttaaaaattgctatatattaagcttgttaatacttccatgctgtatttgtggccatcagtttccccgggcacaggcctgcacattttgccttcacacgctgggtggtttttcattttcacttctatttctcgttcttctatcgttttatgttcagacgggtttctccgtgtagaaagcagtttatgaagatttactttcgacagtcttctctctactttctacagtgaattctctgaygtgtctgggagtwtgggggtctgggtaagartcctcctctcaccctattctctattacgatccacagcctcatgctttatgarattggtggccgggarcgggggagatttgcggatcccccaagccagactttatccccctatccctgcctctggatcccacgtacaggcctgggaactccctgtgggtaggggccaatggtctcgcactctcacctgtaccccagggctggcacaggatggtcaaggagagaggctgcccaagcgcatccytctggtgtccccctgacacgcctccaaagtgagcaggtaggtttcaacagccccacgttgcaggtgggagatgaagctcagggtggagaccagtatctcacagttctctttgcatggccgggtacttgttagtcaactgatcaagtgaaaattctagccccagaggcaggagaatccggaacaaaattaaaccagccagg

SEQ ID NO: 90 - DNA, 1533 bp, Homo sapiens
  SITE (12): n equals a,t,g, or c
  SITE (123): n equals a,t,g, or c
  SITE (1522): n equals a,t,g, or c
  SITE (1527): n equals a,t,g, or c
ggcacgagccgncacgggcagcgccccatagcgccagggaccccctggcagcgggagccgcgggtcgaggttatggatccagcgggcggcccccggggcgtgctcccgcggccctgccggtgnctggtgctgctgaacccgcgcggcggcaagggcaaggccttgcagctcttccggagtcacgtgcagccccttttggctgaggctgaaatctccttcacgctgatgctcactgagcggcggaaccacgcgcgggarctggtgcggtcggaggagctgggccgctggracgctctggtggtcatgtytggagacgggctgatgcacgaggtggtgaacgggcttcatggagcggcctgactgggagaccgccatccagaagcccctgtgtagcctcccagcaggctctggcaacgcsctggcagcttccttraaccattatgctggctatragcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccaaaaaaaaaaaaaaaaaaaaaaaaancccgngggggg

SEQ ID NO: 91 - DNA, 575 bp, Homo sapiens
atcctctggaatctaggtggaagccaccaagccttcttcacacttgcgttctgagcatctgcagacttaaccccatgtggcaatcaccaaggcttatggcttgtgtcctccagaactgtggccagagctgtacctgggcccctttgagctgaggctgaagccagagtctgaagctcagcagggcagtarggccctgggcctggcccctgaaaccattcttttctcctaagcctctgggcctttgatgggargggctgtcctcaagatttttgaaatgcctttggagggtttttgccttgtcttggatattggcttccttttagttatgctcatctctctagcaagtgaatgtttcacaacctgcttggattctttctctaccacagarccaggctgcaaattttacaaacttttacactctgtttcccttttaaatataaatttcaatgttaagtcacttctttgctcccatatctgatttaggttgctggaagtagccaagtcacctcttgaatgctttgctgcttagaaatttcctctactaggtagcctgggtcatcacacttaagttcaaa

SEQ ID NO: 92 - DNA, 639 bp, Homo sapiens
  SITE (62): n equals a,t,g, or c
  SITE (126): n equals a,t,g, or c
tcctttcatcttaagcaccacccgacagggcaggtactattaccatctccgtttgacagatnaggaacctggcacaggaagcatttaagtggattccccaggatcgccccactgtcaggagcagantcagaatgggcctcagcatcaggctcccaatcctggcttctaactgctgcgctctgcccttcyctcwccccacctccccactccagtgcctttggtcatgccactgcagctttcaggccaatactggattagcctcttagtgttcttgtccctgcagccatttccccaggcagcaattccatgtgccctcactgatgtaggtggctcttgtgtcatttgtcacatcctattgaattgtttatgcatcttgttcacactcacagcaccctccctctcacacgtcctccttataaaaatgtccctcagtgtctgctatgagccaggtgcagacttaagtgacagggctgctacgggaaataaaaaattaacaaggagcacctgcctcttaatgcacagtaacaaactatgttaagtgtcaggaaggaaaggttaaggatgccaggaaggcttttaataaataacctgacttagatgggcaggtggtgctgargattaagaacgtgttcttctcga

SEQ ID NO: 93 - DNA, 858 bp, Homo sapiens
cccccgggctgcaggaattcggcacgagagtggctggagtctggctgcagagggaagacatcagcagggagggagccagggcctgtcacatctttcctctggccattgtcctggtctttgtaagcccagaatctccccttccctgaagggaggccagcaccccaggagggcagcaggtgtgctgtgagggttggagtagtgtgagaggtcagggtacactagaatggccatggacaccatgtgggggtgctctgggctgggccacagaacagtgtccttcctgctgctcctcccctgcagcttcccccgaccttgtggtttatttggtttgataccaatcagcagaccctgcaaggtggaggctcccaggcctctcagtcccaccactctcatgtgccagtcacccctactgtaactgcccaatgagtacttcttgcccactgccaagatagagccagtttaccaagacaggggaattgcagtagagaaagagttgaatatacatagagccagctaaatgggagagtggagttttcttattacttaaatcagcctcccctaaaattcagaggtgagaatttttcaaggacagtttggtgggcagggcctagggaatggatgctgctgattggctagggatgcaatcataggggtgtagaaaaggtccttgtgcactgagtccacttttgggtgagagctaccaaggagctgctggtctgctggtcccggtagagccatctggtgtcaggaatgcaaaagtgtggccaggcacagtggcccacacttgtaatcctagcactttgggaggctgaggcaggaggaatgcttgagcccaggagctcgagggggggcccggta

SEQ ID NO: 94 - DNA, 526 bp, Homo sapiens
gcaggggaattcggccacggaggggtttcaacagggcccgtggggtgaggtgcaracacaaagcccataagtgctggcctgttgggacaaatgagagaaatcccatagggtggtgatgacagcgcaytcagccatcytaytcctggggaaaatgaaacttgtgctcctatcaaatgctcagttgtaaaactggaaaaaaattttagaagacatcttgtccagcatctgtgtttatgtctataaaatgtagaaaactaaagcacagagatgttaaatgttttgtccaaggtccaacagctggttagcargcttggtctggtgacctttctactgaaccacagtgccgctgggggaagtcctcagcacagatggctgctgctatagctggggtatgggcagtattagtagttaaccagtcaacccaagttcccatagtctaggttctgcttcagctggaggttagggaaaaacacaagaaaatcccttaccactctaccagtgctgggggatgtactaagagatcccc

SEQ ID NO: 95 - DNA, 426 bp, Homo sapiens
ggcacagggcaggagagacttggtccatggggagaagcctgcagtatagatgggacctccaggagcccaagtagcatagaccctgctgatccggggccattgagccagaggatttgggctgaatgtccccagagacaaaagggaaaggtagatcctttcccttaaagatgaaagccatcgcccgggcttgcttattgctctctctcctggtccttccacatgttgtttctgaacatttgttctggcatcacaatccccgtcatcctgtcatctggcccttcccacctttccaccttatctcttgcagtgtctccgcgtcgacctggcacctgggtgaargcttgctcttgctggtgcccatagcccccagtgtatggtcttgamctccccagccatatggaracccacctcaggagggcccctcga

SEQ ID NO: 96 - DNA, 844 bp, Homo sapiens
  SITE (416): n equals a,t,g, or c
  SITE (471): n equals a,t,g, or c
  SITE (490): n equals a,t,g, or c
  SITE (732): n equals a,t,g, or c
  SITE (835): n equals a,t,g, or c
ggcacagcggcacgagataggaagcttggcaggggcagctcccccagtgcgcattgccctgtaactcgagcgcctgggagtggggagaggcttggaaatggagcagggtggtggacctcgtcttctcctgctcatcccaggcctcctccataacacctacctagcacggcctggggacttcccagcccaaggaacaactgagaatactgagtgccagggtagccctagccccatttcacacctgggcaaagtgaggtcactggattcaaacactcagatttaaacctcctctgtgtctgcagcacctgtatataactgccagcctctgctgcccctctccaaaaagtctctgcccttgtctttggcacctgtctctgtcctccccattctctgctcctcctttctccaactcagantcaccctgttagttcagcaaatgttcatcgagctccataatgtagcaggacaggnctgtctaacagattctggncttgcaagggtgagacaagtactctccatctttctctcatcttcacagatggtctgctcaacaactttgcactgaattgtaaataattgatactgcataaaacattgatgttctttaagggtagtccagcaaggtggcaagtcttataatgataactgctcaaggatctctcagtgaagcatttggggstgctagctctgcctatgggtgaggtcagctatctcacgccatctacttccacntgcccccccatgccaggctcaccctgagctgagatgcctgagcaggtggcagaaaggagccacctggtttatgcttcgggaccacaaactcctctatccagangacagtttt

SEQ ID NO: 97 - DNA, 1985 bp, Homo sapiens
  SITE (332): n equals a,t,g, or c
agccctgctgaagtacaggttcttctatcagtttctgttgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattctyctcaaagccatcgctccgcagcaggaacaccattttcaccctaggaacccgcggctctgtcatctcccccactgaacttgaggcccccatcctggtgcctcacacagcgcagcggnagagcagaggtatccatttgaggccctcttccgcagccagcactacgscctcctagacaattcctgccgcgaataccttttcatctgtgaattttttgttgtgtctggcccagytgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactggggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaaaaaaaaaaaaaaaaaaaaaaaaaaaaaaa

SEQ ID NO: 98 - DNA, 1416 bp, Homo sapiens
atatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtggtggtcggtatgttccgggctcttcgggatcttctaacacactacccacagcagatccttttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttaggtgttgattctcaaataaaaaagtattcctcagtatcagaaccagctaaagtaagtgaatgctgtagatttatcctaaatttgctgtagcagtggggaagagggacggatatttttaattgattagtgtttttttcctcacatttgacatgactgataacagataattaaaaaaagagaatacggtggattaagtaaaattttacatcttgtaaagtggtggggaggggaaacagaaataaaatttttgcactgctgaaaaaaaaaaaaaaaaaaaaaaggaaactcgagggggggcccgg

SEQ ID NO: 99 - DNA, 1760 bp, Homo sapiens
  SITE (24): n equals a,t,g, or c
  SITE (39): n equals a,t,g, or c
  SITE (255): n equals a,t,g, or c
gccttcaactcttgttttattganttatgaattcttaantcttctatggcaggagacatctatggggaggctttgtttgttttttgagacagggtctcatttgtcgcccagggtgagactctgtctcaaaaaaataaaataaaataaaataaaaacaaagaaaaaaaaataaaatctttaggcattcccagacacaaagatctcagagacagacaacagagagcytccgtgttcatctgcccgaggctgtttgtncacagttcccttaaaagatgcctggaaatgctcccaacaacaagggactcaagtatggggctgagtttgttaaaaaagcagctaaatgtgtttaggaaacacacgaagtgaaaccagacagtgatggcccatgtacaagacttgtgcttgaagctttggtgtgcctccatggccaatttttcaggcaccaaaacccattcctgattaattattgttaaaaaagcagctaaatgtgtttaggaaacacacgaagtgaaaccagacagtgatggcccatgtacaagacttgtgcttgaagctttggtgtgcctccatggccaatttttcaggcaccaaaacccattcctgattaattattgatatacaatgcaaaccaaactatgaaaacacagactttttttcagaagagggaaataaaggcacagaaacctgccaaaatagatatttttttccataagaatagtatggttgattaaaatagtttatcactagtaaaacttgtatcactagagcagacaatacaaattagttttttaaaaaatgacattcactgaattcttggtctgtgcattcaatgtgaataatcatcaaaaatatattacaattaaaggtttgtaaggagctctgtctgggatttctgcagtatattatttcggaggagaagaaccaccataaagtatgagctatccactgttcctttttatgtcatgtatggtaatcagtctatctcctaatgcaggctcacaaacttccacggtgagatgtctaagtgacttagtgaccttcacactcattaaaggcagccctgtccatcaaactccatacctagaaagttcaataaactgtattacattttaataaatatktctgtgtactttttgttttttgcttttaagctcagcttaaattttgtcaaggaaaccatttcacaagacagtatgtcacagcctactatcagcaatagtccttgtttattagaatctgcagatgtccatattacatcaaatataaatatatattatatttacatttccttcttagctttcaatttaggtgagtgtatttatagataatgccactaacgcaccactattctaatcctcagtgcaactcataccttctttccattagatgctcattaatgtaagacagcatcttaaaagaggggtactgttcttttttaaaataaaaggaaagaaagggaatccaagaatggaggtctagacatttcctaagagatttttgttttgttttttatacttagaaatacttgaaaaatgtggtccctttttgtagtactagtctctacttggggacaagaaaatagaatatgcaactcagaaaggaaagascccaaagamgararaacctgcttgtttactccattaacctgtttaattaagatctgcttttaaatgcctgatgctgtgccagtatcatacaaaacatcttccaccttccaagcagctgaagcacctcctcaaaattctgtttgtcctgaataa

SEQ ID NO: 100 - DNA, 599 bp, Homo sapiens
gaattcggcacgagcgtccacgcagccgccggccggccagcacccagggccctgcatgccaggtcgttggaggtggcagcgagacatgcacccggcccggaagctcctcagcctcctcttcctcatcctgatgggcactgaactcactcaagactccgctgcccccgactccctgctgagaagttcaaagggcagcacgagggggtctttggctgctattgtcatctggagggggaagagtgagagccggatagccaagaccccaggcattttcagaggtggcgggaccttagtcctacccccaacacacacccctgagtggctcatcctccctttgggcataacgctgcccttgggggctccagaaacaggcggtggggattgtgccgctgagacctggaagggcagccagcgtgccggccagctgtgtgcattgctggcttaatatgcagggcttggggggctgtggccacatgcccggcaggaggtgagtgaggagccctgtggcgtgctggtgtggggatcgtgggcatttcaaacgggcttgtcgtaccctgaacaatgtatcaatagagaaaaaaaaaaaaaaaaaaactcga

SEQ ID NO: 101 - DNA, 784 bp, Homo sapiens
gaattcggcacagaaaaaaaagagagactgggtcttactgtgttgcccagacttgtcttgaactcctgcctcagcctctcaagtacttgggattataggccaagaagccaccatgcctagcttcttcctgtcattgatccagactaatactctggggtcagcctcatttcttctctttctcactttgcacatccacttgtcaccaaatckrgttcattctgcatcctaagtaagtcctttgattcctccagttgttcattagtaatgtctcaartgtaattttttctagtagttttcagcctgtctttcckgccttcagtcttaacttctccagtacatakgccacattgttgtcagcakgatcawattttatttaaaaatactttacawakgtttatkgccaaatattagraaatacagattcatggaaagaaaaatcactgtcccaaggaggtcactggcatggtgaggttaaggggtgattttaatttttaaaaatgtatattttttcctgtgtagagtagtaacacccttgaaaacacawtcccttgtaaagtctctaattctgtactccgcatctagstgrtctcttctttctcagatattttacaatttcatttatcaccacctttctctagcctttacccgtctcttcaatattwacatatgcagaagtttctcctaacaaacacctgcctctgcctcagttctgctaccaccctgttgctttctttcccttcacaatcaaatttaagagtgtcaaaaaaaaaaaaaaaaaactcga

SEQ ID NO: 102 - DNA, 404 bp, Homo sapiens
ggcacgagttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaacgtcaaatttctggacttttttctttcaatttttaatttttaaagtttttttggtattaaaaaatctattcacaagccaaaaaatatataaaatatacagcgaaaagccaaaaaaaaaaaaaaaaa

SEQ ID NO: 103 - DNA, 2218 bp, Homo sapiens
aggtattaggcccttttgtgggagccccatgttttgtttttctgagttggtggggagggasggagggggagggctgaattgttttgcagaggaagatggcatctgtgctttaaatttctcattactgggttagaaaacaaagagggaktgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatagtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgyaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataaaaaaaaaaaaaaaaaaaaaaaaaaaaaaaaaaaaaaaaaaaaaaaaaaaaaaaaaaaaa

SEQ ID NO: 104 - DNA, 1351 bp, Homo sapiens
  SITE (544): n equals a,t,g, or c
  SITE (774): n equals a,t,g, or c
cttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcytcggcctcccaaagtgctgggattacaggcgtgagccaccgtgcctgccccagaatggtttttaaagccacagttgagargccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagarctagaagcacagttcaaagttctggnttctggactctgcagtccaggtytcccttytcccacttgcctaccctcaatgccacactgtttttgaagtggcccataacttgaaggraaagtttaaagacagttcaatttaatcatcagratgcattcttttttttttcggaracggaktttcactcttgctgcccasgctggagtgcaatggtgcaatgatctcggctcactgcaacctatgcctcctgggttcaagngattatccagcctcagcctcccgagtagctgggattatgggcgcccaccaccatgcccagctaatttttgtatttttttttttagtagagatggggtttcgccaggttggccaggctgktcttgtgaaytcctggcytcaggtgatytgcccacytcatcytccaaaagtgctgggattacaggcatgagccactgcgcctggcytcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatgtaaaaaaaaaaaa

SEQ ID NO: 105 - DNA, 2066 bp, Homo sapiens
ggcacgaggcggcggagggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcatttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacattgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattcttgagtataaaaaaaaaaaaaaaaaaaaaaaaaaa

SEQ ID NO: 106 - DNA, 1705 bp, Homo sapiens
  SITE (724): n equals a,t,g, or c
aattcggcakagggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgyggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggnctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatggcttaaccctgactttgggatctgcctgcatcggtgttggccactgtccccatttacattttccccactctgtctgcctgcatctcctctgttgcgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggraaaaaaaaaaaag

SEQ ID NO: 107 - DNA, 1167 bp, Homo sapiens
  SITE (1): n equals a,t,g, or c
  SITE (6): n equals a,t,g, or c
nggagntccaccgcggtggcggccgctctagaactagtggatcccccgggctgcaggaattcggcacgaggccaccaaccgtggcatcacgcgaatccggggcaccagctaccagagccctcacggcatccccatagacctgctggacaggcgccatgtcactctccagggcccggttgaggaaggagaagctctcgatgtccagcatgtggacctcgtcgatgaacagcactccagggatgatctccgccttgccctcctcgcgccactcagccaccttggcattgatctgctcacggacttctgacttgatctcccctgtgtcacctgagaagagcgccaggaagccctgggtgcgagagttgatgacgtcgatctcgtgcagggacacggtgtgcaccacctccttgcgtttctggagctccccatctgggcactgcacgaacttggtctgggagcccatagcgtcgtagttcgcgggcgcgtgtgaaggagcggcccagcttggagatcttgcccgtcgccttgtcgatggtgatcacgtccccggcctggaccttgtccttggtcagggamtcaatcatcttggtgcccaggtcgtagatggtctccatctctgtggtcttgagggtcagtttgcccaccttggagcccgtccctgttgctggtcgatcaatctggatctccaccacctccccttcgatgatctccgtctcctccttgatgcgaacgccgatggaccgccggaaggcctgcgtcagcgcctcggtcttgctcatctccagggagaagatttcactgccggcgatggctgtgaatggcgtgtcagggcccagggcctgcgccatgcccatggcgatggccgtcttccccgtgcccggctggccagcaataaggactgcccgaccggcaatcttcccttcccggatcatctccagcaccacgccagccgcccgccgtgccgccagctgacccaccatgccttgcgaagcctgccgaggctccaaggcatcgtccagccccagtccccggatgtgggagtgggcaccgattcgctcaatccttgttacatcacggatctccgggactttggttgtggctgtaacggttgccatgatgctcaccaactgccagagtctagcggaaaacctctgccgaattcctgca

SEQ ID NO: 108 - DNA, 1907 bp, Homo sapiens
ggcacaggggaatcatcgtgtgatgtgtgtgctgcctttgtgagtgtgtggagtcctgctcaggtgttaggtacagtgtgtttgatcgtggtggcttgaggggaacccttgttcagagctgtgactgcggctgcactcagagaagctgcccttggctgctcgtagcgccgggccttctctcctcgtcatcatccagagcagccagtgtccgggaggcagaaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagcggggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagattaaaaaaaaaaaaaaaaaaaaaaaaaaaaaaaaaaagggcggccgc

SEQ ID NO: 109 - DNA, 611 bp, Homo sapiens
  SITE (19): n equals a,t,g, or c
  SITE (21): n equals a,t,g, or c
  SITE (47): n equals a,t,g, or c
  SITE (607): n equals a,t,g, or c
  SITE (610): n equals a,t,g, or c
atgaattaacgccaagctntnaatagggactcactatgggggaaagntgggtaacgcctgcaggtaccgttccggaattcccgggtcgacccacgcgtccgatggggctttagtaaatcaggcttgcaggctcaaagctgcaatctgcccactctcaggtactgagactttgtgggcctcagacaccaggaagaaagttgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaaaaaaaaaaaaaaaaaaaaaaaaaggggggnccnc

SEQ ID NO: 110 - DNA, 2632 bp, Homo sapiens
  SITE (67): n equals a,t,g, or c
  SITE (2620): n equals a,t,g, or c
tcccagctctcaggacaagggccctgggcgatcttttaaaaaagccgattgggtgtctttctaaaantacaaccagtacttcatcgtcaagtttctgggaagggagtcccctccagattctcatggagtgacaaatcttgactcttgctcctggaatttttcaggcccaaactagcgtttctacaatgatttatttggcaaatttgtcttgattatgggtggctgatgaggaacgtgcttttgttaggaaccgaaactgggcggcggtgagggcgtgtacgcaatgagtccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggaraatctgtccagggtgctttgatccttgcagarctgctttcagcagtgaaacgctcactggctcgaaccctggtcatcatagtcagtctgggatatggcatcgtcaagccacgcctggagtcactcttcataaggttgtagtagcagragccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaactcgatcggcacgagggggggcccggtacccaattcgccctatgggantcgaatgagacc

SEQ ID NO: 111 - DNA, 2249 bp, Homo sapiens
  SITE (1579): n equals a,t,g, or c
  SITE (2226): n equals a,t,g, or c
gaattcggcacgagctcaccgtgctgcgtgacacaaggccagcctgcgcctacgagcccatggactttktratggccctcatctacgacatggtactgswtgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcgctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagamacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggctttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaansccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaaaaaaaaaaaaaaaaaancccgggggggggcccggacctgg

SEQ ID NO: 112 - DNA, 2198 bp, Homo sapiens
  SITE (123): n equals a,t,g, or c
  SITE (621): n equals a,t,g, or c
  SITE (640): n equals a,t,g, or c
gatactataaggcaagtgactcacgggtgcgccgttagactagtggatcccgggtgcaggaattcggcagagcgccgccggagccgaagtgctggcgcccccgcggccgctgcctccgcggancccaaaatcatgaaagtcaccgtgaagaccccgaagaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaawcccyttgttcagagcatgctcntcaaatcctgacctgatgnagacagttaattatggccaatccacaaatgcagcagttgatacagagaaatcccagaaattagtcatatgttgaataatccagatataatgagacaaacgttggaacttgcccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatctkgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaaaaaaaaaaaaaaaaattcctgcgcccgcgaattcttct

SEQ ID NO: 113 - DNA, 1043 bp, Homo sapiens
ctgaagtgtatgtggtgaggaagaagaggctcctactgtagacagccttgttctacagatcctcccagaaatctctgggccaggtggaacccagggtcagagagggatgggagagaggtttaattttccatgataaataaaaatctataaaataataaacaagagaaaagagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggargacttggatgggtttgagggttactccctgagtgactggctgtgcctggcttttgtggaaagcaagttcaacatatcaaagatwaatgaaaatgcagatggaagctttgactatggsctcttccagatcaacagccactactggtgcaacrattataagagttactcggaaaacctttgccacgtagactgtcaagatctgctgaatcccaaccttcttgcaggcatccactgcgcaaaaaggattgtgtccggagcacgggggatgaacaactgggttagaatggaagkttgcactgttcaggccggccactcttctactggctgacaggatgccgcctgagatkaaacarggtgcgggtgcaccgtggartcattccaagactcctgtcctcactcarggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcgaaaaaaaaaaaaaaaaaactcga

SEQ ID NO: 114 - DNA, 703 bp, Homo sapiens
gaattcggcacgagtgcgcgggcaccacggcggtttttcgacgctggcggtggacgcaggcagcatggaccacggttgctgggcggatggggagcgtctatggtcagttgccttagaagtggtgagatgggaagctgcagttggaagaccctggaggatgcctgacaaggggatgtctgacacatgattggagctctttttgaaatgtttcttgcccttcctggagcagaggagccattatttatgcaggtacatcgaagtcttttgacctccatacagtgattatgcttgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggtgggcacaaaaatcttcatgagcaatacttcttagtagattgttttgttattcaaatcaagttctagtgtttttatgtgagattatataatttacagtgttgttttatatacttttgaataaa

SEQ ID NO: 115 - DNA, 3684 bp, Homo sapiens
  SITE (79): n equals a,t,g, or c
  SITE (2297): n equals a,t,g, or c
  SITE (3679): n equals a,t,g, or c
ggcagagggggcatgagcaggaggaggattaccgctacgaggtgctcacggccgagcagattctacaacacatggtggnaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgcccyttctggtgttggtatgtctgttgccggccatgggctncaygccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaaaaaattcgggggggggcccggtncccat

SEQ ID NO: 116 - DNA, 1965 bp, Homo sapiens
  SITE (51): n equals a,t,g, or c
  SITE (476): n equals a,t,g, or c
  SITE (1136): n equals a,t,g, or c
aagaaagggtattaaaattctagatcacatatggacccgggaaggtttttnaccctctgttagtgacatcgagtctcccactagacaaaataggtggaaaaatctctcgagggctcacattgttttgtcatcttcaggaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggnccgcttgctgcctgtctgctttccttggtggytttgctgggtgctgggcctgccctctccggccgcttgctgcctgtctgctttccttggtggctttgctgggtgctgggcctgccttctctggctgcttgctgcctgtctgctttccttggtggctttggcttctgcactccttggcgtcasctctcaggtcctccattcacacgaggtcctcctcgctctggccgctcttgctgctcctgtctgaagawatcagactgatttcctcttaagactcctagggatgtggtgaagagctgggactcaagtgcagtccacggtgtgaaacatgagggargtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcangcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaagctgtctttgttcaggctgctataacaaaaatataatagcctgggtggcttaaac

SEQ ID NO: 117 - DNA, 503 bp, Homo sapiens
agtgatccccttgcctcggcctcccaaaatgctggaattgtaagcgtgggcctctgcacccggcctggtccgcaatttaaaaacgcacagccaccattccctytccagaaagcacccagatgcctttgggagaaccagcctcctccatggaggaaagcttgggatctgccttcccacctggggaggagagggatctgtggaaaatccttctgacggacttcccctcagtgcctgatccatactcaatagtagaaaaagtaagaaatatacaaagatagcagatacacggagacagttccccaaatagctgagcgawtagcgcagaagcaatattgaagacctaatagctgagacatttccagaactgataaagtgcatccagccacagatcaagcagcccagaaaattccaggcagcatcaacaaataaatagccccacatgcacccgtgaaaatgcagaagaccaaacaaaaaagtccggtcaacagccagagttaaagagg

SEQ ID NO: 118 - DNA, 1071 bp, Homo sapiens
tcgacccacgcgtccggtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttycccatggggctggggtactttacattcaataaatactgtttaacccaaaaaaaaaaaaaaaaaaraaaraaaaaaaaaaaaaaaaaaaaaaaaaaaagg

SEQ ID NO: 119 - DNA, 1101 bp, Homo sapiens
  SITE (147): n equals a,t,g, or c
  SITE (376): n equals a,t,g, or c
  SITE (395): n equals a,t,g, or c
  SITE (1101): n equals a,t,g, or c
gggcacagctgaagctgcagacctccccaggggatggctcctctcccccaggagccccgaggcaggggaggcagaaagcctgggctctggggggtggcctgcggacagctgtgctgtgggccgggggctgggcctgtcccacagggncgtggagctcgtggttctgagcagccagctgggtggtgtctggggatagctgggaggcacagcggctgccatgtgggactgggactggagtgctccctggtcttggcctctgtggctcagccttgctctggtctgcctgagtgcaggggccaaggggcacagggccagtgaggccggccacgctcgggccctcacctgtgagatggggtcggaatttkacacagcctanggcttggttcttggtkgtngamcgtggactyctkagaacgggagtgctggtcctgaaaggcgtggttggagaccagctgcttttctcgctgtttttctcttaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttaaaaaaaaaaaaaaaaaactttgggggggggccccn

SEQ ID NO: 120 - DNA, 282 bp, Homo sapiens
agcttctctgtccagtcttgaactctgggstctcttggaactttcctcacccctctcagcctgaatattccttccatggattccactcaaccagactttggatctgtgcctacttaatcaaccttatctttgcaatatgttcgggcccaccttccactccttggttcttgttcctccttggcctaacttgtcccttctccacttcacatccccggtgggacagcattcctccttcctcccaacctccctccgtctcaraaaaaaaaaaaaaaaaaaaaaatt

SEQ ID NO: 121 - DNA, 2635 bp, Homo sapiens
  SITE (2605): n equals a,t,g, or c
taagggggtgtgtgctcacctcctcctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggyttccttctggcccctctgaggattccctagggctgccccgcagaggggyttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttyttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatccygtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccayatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccccactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggargggtggtgggtggcggcatcttgactgccccctgttgtcccacacgtggggggtggtcaccccycttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgcccygcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaaaaaaacccngggggggggccggtaacccatttcgcctaa

SEQ ID NO: 122 - DNA, 994 bp, Homo sapiens
gaattcggcagaggttcggcgaagatagggaataaggaagcacaggagtaggggagaaggaagcacaggagtaggggagatatacagcggtcaggataagggggaaagggcggtggttgcscaagaggtgaaacaagatgtgagagacaaggggtagggaagaaatggggcagcggttaggttcagaagcgcatagaccgtggcggacgggcaatgcgaggggcacagaaaggaactgaggggtgggctattttaarggagatggtccttcagccctcttyttttctgcgtagttctcctcctccaggccgcgcgcggatatgtcgtccggaaaccagcccagtctaggctggatgatgacccacctccttctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttaaaaaaaaaaaaaaaaaaaaaaaaaaaaaaaggggagggg

SEQ ID NO: 123 - DNA, 1542 bp, Homo sapiens
  SITE (1445): n equals a,t,g, or c
  SITE (1515): n equals a,t,g, or c
  SITE (1520): n equals a,t,g, or c
  SITE (1535): n equals a,t,g, or c
ggcasagccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtcttaaccctgctcagcagactctctactttggggagaagagagcccttcgagataatcgaattcagctggttamctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttccttggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccagggccctgtggggacttgctggggccgtcaccaacccggacttgtacagagcaaccgcaggggccgsccctcccgnttgttccccagcccacccacccccttgttacagaatgtytkgtttggggtgcggttttgtwattggtttnggatnggggaagggaggganggcgggg

SEQ ID NO: 124 - DNA, 1390 bp, Homo sapiens
  SITE (498): n equals a,t,g, or c
  SITE (499): n equals a,t,g, or c
caagctctaatacgactcactatagggaaagctggtacgcctgcaggtaccggtccggaattcccgggtcgacccacgcgtccgggcctcagggtggacgcatggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaaytcacctgtcggggaaaattggagctaagaaactgcggaanntggaggagaaacaagcgcgaaaggcccagcktgaggcagaggaggctgaacgtgargwgcggaaacgactcgagtcccagcgcgaatgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctgagcttggtgtggcttggtgtggcagaaggcctggcctaggatcctagataagcaggtgaaatttaggcttcagaatatatccgagaggtggggagggtcccttggaagctggtgaagtcctgttcttattatgaatccattcattcaagaaaatagcctgttgcaaaaaaaaaaaaaaaaaaaactcga

SEQ ID NO: 125 - DNA, 1288 bp, Homo sapiens
  SITE (1286): n equals a,t,g, or c
ggcgcgcgggtgaaaggcgcattgatgcagcctgcggcggcctcggagcgcggcggascagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcatccggcagagggaggtggtggacctgtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacatgtttttaaatctagcattattcattttgcttcaatcaaaagtggtttcaatattttttttagttggttagaatactttcttcatagtcacattctctcaacctataatttgggaatattgttgtggtcttttgttttttctcttagtatagcatttttaaaaaaatataaaagctaccaatctttgtacaatttgtaaatgttaagaattttttttatatctgttaaataaaaattatttccmacaaccttaaaaaaaaaaaaaaaaaaaaaaaaaaaaaaaaanaa

SEQ ID NO: 126 - DNA, 1517 bp, Homo sapiens
  SITE (159): n equals a,t,g, or c
  SITE (1123): n equals a,t,g, or c
  SITE (1510): n equals a,t,g, or c
agtggcttaaaggcatcgttttagggattactgggaagtatcttcaaagtaatacatgagaaacattccttcctaaatcctttattatattgaatatcgtattaattggttttcagaggttaaattaaccatgtattcctgcaataaatgtcacttgtntcttgtatataatcttttttatatattaccggattgattcattagtattttgttgaggatttttgtgtctatattcataagagatgctggtctgcagttttctttttttgtgataatctggtttttgtatcagtaatacaggccccatgaaacgagttgggaagtgttcacctctcttgtattttttcaagagtttgtgaagaattgctattaattctttaaatgtttggtagaatctaccattgaaatcatgtgtcctgggcttttttttgagggaagtgttctgataactaattcagtatctactttttatagctctgttcagattttgcttcttcctgagttagttttggtaatttgtgtatctctaggartttgtccatttcatttatctcatttgttggcataaattaaactaaatttggcctgagcctacctgtatatcttgagtccctctgtaaggaactgtagcctaacttgtacataaacaaactgaaatcctaaattaggaatgtagtttttgtaacagctcctgagtctcaggcagtcacagcagycaagtctgtcaattgcaggctgctaactaagcagcccatgstcaaatgaggcaaaaacctttgcttttaacacatagtatagctttgtaatccttttcttgcacactcgggtaatttcttcctttttcattccckgwattttccakgaatatgartctyccttttttcccctcctgtcagtctagctaatggtttgtcaattttgttgatcttttgaaraacaaacctttggttccactttcttgttgcatatgctgartattctcataattggagtggaaagctgatctttgattacttattttacttagggctgaggagttcatggacttcgcaaaacctccttgaatctaaattgcatcttctttcctggtttctgggctgaaacatgttttttcccatctwanawacccttggtcttttcatkggcgattaagactagagaaagttctagatmccttgtccttttatgctgtcattttgtttaaaggctttctatgtagtaaaactatctatatagacaaaatagagccttgagttgtggtcttgaatttgatcaacatgatttaccacattctgtactggatatttcttcacctgctgctactgtaaaccattttattcttggatcttctgtagagtatattatcacaggtactttttacaggggtgtctaatcttttggcttccctgggcacattgaaagaagaagaattgtcttgggccacacatcaaatacgctaacactaataatagttgatgagctaaaaaaaaaaaaaaaaaggcaaaaaagncccaaaa

SEQ ID NO: 127 - DNA, 1073 bp, Homo sapiens
  SITE (495): n equals a,t,g, or c
tgaatctattctttgaacattctacaacaagaattacattatactgttataccagagtacttctgcagtgtgaaatagattggtttggaaaatgaacctggctttgctataaattacattcacaggcctttttgcaaatgtgtaacttgcctatcaaagtagtttgtagggcaaatgcagaatatatgtctccatctggtaaagtaccttwtaytcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtagggrmgatcactcatgmtaggtatggwtctccttacccttggcctctgwwtcatattttggcctatcaaaaacagtgggaagtcaaacgtaagntgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtaaaaaaaaaaaaaaaaaactc

SEQ ID NO: 128 - DNA, 300 bp, Homo sapiens
  SITE (273): n equals a,t,g, or c
  SITE (294): n equals a,t,g, or c
caacccctgccttttttttgttttccatttgcttggtagatcttcctccatccctttattttgagcctatgtgtgtctctgcccgtgagatgagtctcctgaatacagcacacttactggtcttgactctgtatccaatttgccagtctgtgtctttcatttggagcatttagcccatttacatttaaggtkaatattgttatgtgtgaatttratcytrtcattatgwtgttagctggttattttgcttgttagttgatgcagtttcttccnggcatcaatggtctttacaanttggca

SEQ ID NO: 129 - DNA, 1275 bp, Homo sapiens
  SITE (1152): n equals a,t,g, or c
ggcagagcctgtccctgctgcccctgcaaaaaaaaccccctctggtgtgagcaggatggttggaggttatgtgagctccttctcctttcctccagtttcctcttcccttctcctccctgcctcttttgcttttccctttcttcctggtaccccctgcccattcctgtattttctcccatcgccattctcccctctcccactgtccctaacccgttcaaactctttcctcttaaatggttgagattttctctcaccaagcacaccccagtattaattaaactagctgcaaacaggcagcaagtggtctaccatgacagatgggttttgtgtgtgtgtgtgtgtgtgtaattgtaataaaacatattgartcactcaataaacacagagtgtctactacatgtatcargcactatcatagatgctaattaacgaaactgaaatggccaggccctcacagtggctcatgcctataatcccagcactttgggaggatgaggcaggaggatcacttgaggccgggagttcaagaccagcctgggcaacatagtaagactccatctctacaaaaaaaaaattttttttattatactttaagttttgggttacatgtgcagaacgtgtagttttgttacataggtatatacgtgccctggtagtttgctgcacccatcaacccatcacctacattaggtatttctcctaatgttacccctctcctagccccccaccccgtgacaggccctggtgtgtgatgttcccctccctgtgtccatgtgttctcattggtcaactctcacctatggagtgagaacatgtggtatttggttttctgatcttgtgatagcttgctgagaatgtkggtttccagctttatccacgtccctgcaaagggcataaactcatccctttttatggctgcatagtgttccatggtgtatacgtgccacattttcttaatctatcattgatggacaagttttgctattgtgaatagtgccacaataaacatacgtgtgcgtgtgtctttatagcagcatgatttataatcctttgggtatatacccagtaatgggatcactgagtcaaatggtatttctcgttctagatccgtaaggaattgccacactgtcttccacaatgtttgaactaatntacactcccaccaacagtgtaaaagtgtttctatttttccacaacctctccaacatctgttatttcctgactttttaatgaacgtcattctaactggcgtgagatggtatctcattgtggttt

SEQ ID NO: 130 - DNA, 472 bp, Homo sapiens
  SITE (2): n equals a,t,g, or c
  SITE (471): n equals a,t,g, or c
  SITE (472): n equals a,t,g, or c
cngaaaccccgtgaaccctccccgggttaaaaagccccccctaaatggggggaacgcytcacacgttataaaaaagcactagaatgttttgaaagcgagaaacaacagctgtgtagggtagctagcagttagtgttgtacagaagacagatatttgtgcatttytgcattttctaagtttgctgcaatgagcatgtattactttcatagttataaaacacatgcaaaatgcccttttaaaatgaaaaaaaatccatgagtgtaagtgatatatatgctttggaaagcctgggacggtcattgtttactctcaatagtatgtgtttgcctttgtctttttgagacattttgttttaatctgttgatgacaataacctgttgataatataacttgataacaaataaaatgacttatgattgaawmaaaaaaaaaaaaaaaaaaaaaaaaaaaaaaaaaaaaaaaaaaaaaaann

SEQ ID NO: 131 - DNA, 1950 bp, Homo sapiens
  SITE (132): n equals a,t,g, or c
  SITE (225): n equals a,t,g, or c
  SITE (249): n equals a,t,g, or c
  SITE (577): n equals a,t,g, or c
  SITE (1933): n equals a,t,g, or c
acctctcagaatcttctctcagcaacctgagtcttcgccgttcctcagagcgcctcagtgacacccctggatccttccagtcaccttccctggaaattctgctgtccagctgctccctgtgccgtgcctgtnattcgctggtgtatgatgaggaaatcatggctggctgggcacctgatgactctaacctcaacacaacctgccccttctgcgcctgcccctttntgcccctgctcagtgtccagaccnttgattcccggcccagtgtccccagccccaaatctgctggtgccagtggcagcaaagatgctcctgtccctggtggtcctggccctgtgctcagtgaccgaagctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgnctgcccagtattctaccaggcctggtgctggcctcctgtgatgggccttcgmactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtctttttcaaaanaaaaaaaaaaaaaaact

SEQ ID NO: 132 - DNA, 990 bp, Homo sapiens
  SITE (657): n equals a,t,g, or c
  SITE (852): n equals a,t,g, or c
  SITE (859): n equals a,t,g, or c
  SITE (962): n equals a,t,g, or c
tggaagatttaaaataggtttcatatttctcttgaatatgaatatataagcttgaataagcttgagtccttattattatgaaattttccttattatttctaccaatgcttcttatattaaagcctgatctttttcatattagtatatgtacattagctgcctgtggattaacatttccatgaaatgtatttttgcattgtttgatcttaaactttttgtgtctttatataaggtatgctycttttaagcatgatatttttaaccacaatagttgaaagacaatctycaccttttacttgtatatttacatgtaatgtaatttttgatgcatattacgtcttattatttaaccaacctattttattttatctagggcatttttcagaaagccttattttcttgtattaatcaaatatttttaycattgtattttccyctattagttagkaatacgktacycyaaatatatattgtggstattttcagaattgcaatatgcctccttaatttattagaggctaacctaaattattacttttaccacttacttgaaaattctggaactttagaacatttattgttttatgcattttaattctacttgtatttttactactcctaaacattattattgttttagacaagccaaaatatatnttgttattatcttatyctccatttctttctgtatttttatgccactatgtatgctcaatttccttctatgtgatgaacctaattcagtacttttgttttttaatctgtgcaggtagcctggccattaaatttttatttttggtttgctgaaaaaattgtgtttatttctatatgcatacttatgcatatagaatnctaggtngacatatttttagtatttataaatgtaaagtcattwattkggcttctatcatttckgtkgagaaatcaattgtcagcccaatagtttttcattttaaattacngaattttttcatgtctctggttttagga

SEQ ID NO: 133 - DNA, 1720 bp, Homo sapiens
gtctgataagcgactgtggttattcccctaaagtttacttcagcactaacactagtgcttccgctggagtttgcagttttccagctttatacaggattttcctttgactggaagagtcaaggatatagagactcaacagtgacatttattgtacaacatcaaggggaataggatactcatcaaactgggattattcttatcaaaacatggtcttctttgaataagaaaaatacatagttggttattatggacttaaaactgtgttaaatggatattctgataaaatatttgctgctctgtagagtgtggaaaatctgagaatattagctttactcatcttgagctttgaggatgttctctgtacgccgatggtttcatattaactaaaaaagctgggtattgtaaaatctcatttataaaaactcagatgagaagaaaattttctttgatggtgagactgttgtcttagttcaggaaattatttaataatcctttgttacctgtgaatgaaggaactttgtaattctgatttatcgtaaaacatgagcctttccagagtcagcttagacactgttgtcgcaaatagccatgctttgccttatgccaaggaggcccagagggagggcctagtcttcctctgttgctgtacatatattgaaatgctttttttttttattttgcatttgttatctataatgagctttctgagccctgatattatgtgagacaaacaggagttattgatgttatacactcccttccattcaggattttctgcttggagggaaatatgttgaccttagagaattgtgaatattgttgcaattcttgaatatattaccatgtgaataatagagactgtgttgctctctagtataagctatatttatttttgattcatttgaattactagttataactggagaaattttgttacctctatcctggcttgcctgactggctgtataatagcagcagcctcttttagagcatcttaatgaaaacatggatgaaaggaattaatgatgatatctgcagactgcgtagaaaatggcttttgttcccagcgttaacattttcttctcaatcacatttcaatgtttgtggagagtggcagattcacaccagaaacactaggtgttcatatccatagcatggatgcagaataagcagttgggagagaagcttcttcctacctggtactcctcccattcacctcagcccagccccagacaggcgttagcattcagtgtgggccctcaggcagccctgaagcctggctgggtcatcagatgggggcagcctgtgacgggcaccagcggcctgattccagggaagagttcctggagggtgttggctgtttttgttagctcagtttttttctgggctccaccattcctaactccaggtagacaagatagatgtcacacacaacaattttaaagtattttgcttagtgcattttgtttatgattgcagtgtttgtttcttatttaataggctttttacttcattctattaaattttagtgtttagaagaggcgggtactgtcactgtgtaaaatatgtaatattttatatgttataccatgtcatatatacttgcaatatcagaccttgcattcaatatacaatgcaattgactctttgcagacctgcatttttcagtgaacaataaaaagattgtctggcactccaaaaaaaaaaaaaaaaaaaaaaa

SEQ ID NO: 134 - DNA, 705 bp, Homo sapiens
  SITE (349): n equals a,t,g, or c
  SITE (409): n equals a,t,g, or c
ggcacgaggccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtnaaatctgggaagacttgactgctattccattttgggtatcatatgtaccttgatgaagangattaggttgggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagtttct

SEQ ID NO: 135 - DNA, 323 bp, Homo sapiens
agcacacacctcctttagttgctcctaaggtcatgttcaacattcgtggagtgcattttctgctcagggagctttcccagacccggaatgtttggtgctcacagacyctggcaaggatcggtattgctgttcctcagttttgcctggggaaatggaggstcagtgacgttcagtgacgtgcccagagtcatgccattggcgggtggcccagkgmtccaggtctccagcacccctcggccccctcctcaccaggtcacatcatctcctggattagaatctgctcacatagtctgtcctgaaaggaaaaaaaaaaaaaaaaaaac

SEQ ID NO: 136 - DNA, 582 bp, Homo sapiens
ggacggaatggtgcaaccctcctwamttttctkgkgctgttgacaacagagggagggagggaaaacatttttygtgggagaatcctacytctgcagsggagcccttaagcgatkgattttgaatctkgaccctttaccaactaattttgaaggaagataccttggaaatatttggcattcagtgggttactgaaacagcattagtgaattcatctagagaactctttcatttattcaggcaacaactgtacaacttggaaaccttgttacagtccagttgtgattttgggaargtatcaactctacactgcaaagcagacaatattaggcagcagtgtgtactatttctccattatgttaaagttttcatcttcaggtatctgaaagtacagaatgctgagagtcatgttcctgtccatccttatgaggctttggaggctcagcttccctcagtgttgattgatgagcttcatggattactcttgtatattggacacctatctgaacttcccagtgttaatataggagcatttgtaaatcaaaaccagattaaggtttgactggtttcatttgatttttaag

SEQ ID NO: 137 - DNA, 1021 bp, Homo sapiens
  SITE (248): n equals a,t,g, or c
  SITE (1004): n equals a,t,g, or c
  SITE (1014): n equals a,t,g, or c
ttcggcagagcccttgcgcgctcttgaatacctgckttctgtagcgctagttctcttcaagatttgcttagtgtcatttcatttcggtttcttttctcgccatgtttttctgtcggaattacggttcgttttggttctatgtactctctaaaatgttatcgtttttcatttgtctactaattttcgtgcatttgttactactgagtttcttaatatctgactggcctccgcccacgggctctgcagancataaaatactcaggctgatggtagtgcagagactctccctccttgatcagcgcaaacgttggtctgaggcttgagggatggagcaacattttcttggctgtgtgaagcgggcttgggattccgcagaggtggcgccagagccccagcctccacctattgtgagttcagaagatcgtgggccgtggcctcttcctttgtatccagtactaggagagtactcactggacagctgtgatttgggactgctttccagcccttgctggcggctgcccggagtctactggcaaaacggactctctcctggagtccagagcaccttggaaccaagtacagcgaagcccactgagttcagttggccggggacacagaagcagcaagargcacccgtagaakargtggggcaggcagargaacccgacagactcaggctccrgcagcttccctggagcagtcctctccatccytgggacagacagcaggacaccgaggtctgtgacagcgggtgccttttggaacgccgccatcctcctgccctccagccgtggcgccacctcccgggtttctcagactgcctggagtggattcttcgcgttggttttgccgcgttctctgtactctgggcgtgctgttcacggatctgtggagctaagcagccttagatagcagcagaaggctttttggattctcctccttgaaaagattctcagttaccaaacgtctccacctagaaaataaaaatacattaagatgttganaaaaaaaaanaaaaaaa

SEQ ID NO: 138 - DNA, 1777 bp, Homo sapiens
  SITE (58): n equals a,t,g, or c
  SITE (118): n equals a,t,g, or c
  SITE (237): n equals a,t,g, or c
  SITE (661): n equals a,t,g, or c
gattgtttacgatcatatccggcgatttgggtaccgggcccccccccgactttttaanttttttttttgcgagacagggtctcactttgtggctcaggctggagtgtactggcacgtncttagctcactgcagccttgaactcctgggctcaggcaatcctcctaccttagcctcctgagtagctaggactacaggaatgtgccatcatgcctggctaatttttaagttttttgtanagatgggatctcactatgttgcccaagctggtttcagattcctgtgctcaagggattctgctaacttggctccccaaagtgctgggattacaaatgtgagccactgtatctggcccatattcttttttaagaaaaagatgcagaggtgttaaatattaatatcaaattgtccaggcatggtgtttatgaaattgtgtgccctctgacaggcaaccaaacacacacgacttcatttctttattaattcctgcctcatcatcttttctcattgatgctccttaatgtcaaaggaatctctctctctcacacacacataagaccaaaacaaatatcttgaacatgcaaaaaaatagtctacgcttttgaatagtgtgcactgttgaatagtgtgcactgttggatagtgtgcactgttgaagtgtgnatgtgcctaaggcaacaggatcttgggaaagctctagatttttggcytcgaaataaaactgcatgttgaatagcaggtttttacatttattattgttgtgtatttcctcccctttttgcaatactatctacgctgagttatctattgccaactagcaccaattctccaaatcaaagtgtgtgaggaaaacacactcgtgcaatcctctttaacagaagatacaccaagtaacctgtctgtctacttctgttacccagaaataaaagaacttgaagggctgcttggctggaggggtccgggtgggagagcatcctgccctcagtcggaatccatggtgaacagctggatgtcctgtggattccagtacaggccgactgctgagttgtagacaagagaccagacataggggataaaaaactcctcgggctgctcctcttccacatatttgaatttcaattctggaaatttcttcagtctgtctttgggcagcgcaacgacgccttgcttaatgatttccaggacccgttccactgacagctcagctcccagcttgcagcaaccttgagctaaagaaggagatcaccagatcaatattttgcattatatcctgaaatgaaggatgagttcgaaattgttcaaagagatcgcgtttgtaaagcagggcgtataccaagtttgggttgtggtgaagggaatttgtcaggcaggagttgatgatctctaacatcattcgaatcacttcttcaatgacatttaggtcttgtgcataatctggtagaggaacatcattagaactcagcgaacctctcaaggactgtgtggcttgttccagaactttgttgtgttttttagacagcaaagaaaataaactgatgatcctctgggcagcatactgatggagagaacgaaactgtgccgacatatttgctaaagctgccaaacaatttgtgtgaaggtacttgtctcgtgtcctagtcatgttgtattgaatggttcttattaccaccaggatcaggagactccccaaggagatttcagttaaaactcgttctgaataccaagtaatattttttagtatcacttcatgaatggatctgttgaagccatcatcttccg

SEQ ID NO: 139 - DNA, 643 bp, Homo sapiens
tttttttttttttttttttttttttttttttttttttgggaatgagaaaataactttattttcattgtggggagcgggccgatgtccagcctcagaacttctggaactgcttcttggtgccggcagccttggtgaccttgagcacgttgaagcgcactgtcttgctcagaggccggcactcgcccactgtgacgatgtcaccgatctggacgtccctgaagcagggggacaggtgtacagacatgttcttgtggcgcttctcgaagcggttgtacttgcggatgtagtgcagatagtctcggcggatgacaatggtcctctgcatcttcatcttgggtcaccacgccagagaggatccgccctcgaatggacacattaccagtgaaggggcatttcttgtcaatgtaggtgcccctcaatagcctccttggggtgtctttgaagcccagaccgatgttcttgttagtaacccgcgggagcttctccttgccagtttctcccagcaggaccctcttcttgttttgaaagatggtcggctgcttttggtaggcacgctcagtctgaatgtccgccatcttctcgtgccgmaytcctgcagcccgggggatccactagttctagagcggccgcaccgcggtggagc

SEQ ID NO: 140 - DNA, 1220 bp, Homo sapiens
  SITE (404): n equals a,t,g, or c
ttttttttttttgagatggaatcttgctcttgttgtccaggctggagtgcaatggcacgatcctggctcactgcaacctctgcctcctagcttcaagggattctcctgcctcagcctcccgagtagctgggattacacgtgcccaccaccacgcccgactaatattkgtatttttagtagagacggggcttcaccaggttggccaggctagtcttggaactcctgacytcgtgatccacctgcytcggcytcccaaagtgctgggattacaggtgtgagccgtcttgtgttttttgtttttgtttgtttttaaaagatggartttcactcttattgcccsggctggaktgcaatggcacratctcggctcaccgcaatctccacctcctgggctcaagcaattnttctgccccagcctcccaaagtgctggaattacaggtgcccgccaccatgcccaaccaattttcsgtaytcytagtagaggtggggtttcacaacgtkggccaggctggtytcaaactcaaaytcctgacytcaggtgatctgcccactttggcytcccgaaatgctgagactagaggcgcgagccaccacgcctggcctacaaacacattcttgtttgggtttttatataaaatatgagcacaaaaatactttccctaaatacagcctctggctttgcctaacccttggcacacasccaagtacctcttccattctcagatacgtgaggggagtgtatagaggtttagagtacatacgtttcttctccaactcttcgtcgtctagaagaagactaaccacctctttgggtttcaaggtatctggtttgaagttcccacctgaaatcaccatccgctgaatctcactcttctccttggctctttgcagaatgcgttcttcaatggtgcctttacagatgagccggtacacagtaacctgctttgtctgccctaagcggtgggccctgtccatggcctgctggtccacagtggggttccagtcgctatcatagaaaatgcactgtgtctkcagcagtgagattgatacccagtcctccagctcgtgtgcttaacaggaacacaaagatgtcattcctgttctgaaaatcagcaaccatgtctcgcctctccgagatcttggatgagccatcaagcctyatgtaggtatgcttcctgtaaaccatgtattcctccagtaggtctatcatcctcgtgcc

SEQ ID NO: 141 - DNA, 721 bp, Homo sapiens
  SITE (623): n equals a,t,g, or c
  SITE (626): n equals a,t,g, or c
  SITE (638): n equals a,t,g, or c
aattcggcacgagccaggttagccggaagggcagctctccaggccctgcccaccccacagggggctccttatgcacagcggggcgtctccttgtggccatagaaacggaactggctcttttcaacagtgctgcaagaggatggttatttaacgctggcccccaaggaggaaaggcacagacyttcctccctcctggaacatccaagggcactggatcctctgtgtccctctgagatggggtgccactccagcaagagcaccacggtggcagctgagtcccagaagcttgaagaagagygcgagggaagagagccaggtctggagaccggcacccaggcagcagactgcaaggatgccccgctgaaggatggaacccctgagccaaagagctgaaatgcctctctccagagtcggaccctcacctcyttcctggaactgcctttggccccagaaccatgagacaatccccaccctgagaagctccgatcactgggaggagagagaaagcctccagctttgggattcaggcttcagaagtttttagcagcctttgctcattggagaggtggggaaaggataaagttcttataaggaaatccctaatttcccccagctcctccccnccngaagaaggaacnaaagaaagttccttccacacgttttgttggaaacttttcccttgccaactttccttggattgccagaacaaagccctccagaa

SEQ ID NO: 142 - DNA, 1468 bp, Homo sapiens
  SITE (901): n equals a,t,g, or c
atgaattaatgtttataaatgactgtactgaatttaaaaccgtacagtttcatttgcattttgacattactttattatacattttgcatttaaaaggctgcaccagttggcttttcttctgttttattctcaaaatatagagattctgtgatttatttgccctgtttatggattaaaaagaaaattctaatataaagcatttcaataggatgcataggtatattacgttttttaaatgctttagatctgtgattcttgacttactatttattttatcccctttaagtcagggatgctttattctattttaaagcacttatgagttacatgttgtaatcaagtttgcacaatatatttatctatatgaggaacccataaatgaatagctaatttttaaaatgccattaaaatgcatgaaatkcttattaaaaccttactatactatttcttcaaggcaagtaaattgaccatgrgraaagracacagttattaaacactgttgacaggaaaattctccttgataacataggacaattaatggaaaaaaaaattctcattatttgcaaagaatgaacaagttaatgaacaaacaaactagatttggtatgttttcagcttttgtatcatgtttaattgtttaatttggttgaaaaactgcagttgagaaatcagatagcaatatagacattcacagcagctctgtggataccatgtaattgtcaggtaatttcagaatgttgaaaattattcagtgcagccctcatagtatcatacttgaagaaattgattacagttccactaaattgttgaagataaattatttttaaaggttatgaaaactaagttatattaattcatatgtttgatttttaaatcccacctcctcaagctatccaatttnctgactttgaaaataaccatgagagatgccacatttctctctgggaaactaccactcaaagaataattgttaaaaattaagcttttaggtattagaagctgttataaagtataaaattaagatataagcagatcacatgtaaatcattcctaaagcacaagaaaagaatgtgccttgatgtacatatattactaagttgcctctcccagtttactttaaaaatggctttaaggataaagaataaatgtgatagctgtgcatgcattatatatttgcatttgcaaatttcccattgttttaacagctgtgtggctgactttcaattttaagacgtgaattgacatacagcccataactttataatggctgctcatttatcttatctttcagttagtggaaaaacatttcaacctgactaaaatttggaattgtgtcttttatgttccatcctctgttgttactagatttagtttaaaaattgtgtatgaccattaatgtatgtcataaacatgtaaataaaagatgttgaatcttgttgaaaagcawraaaaaaaaaaaaaaactcga

SEQ ID NO: 143 - DNA, 300 bp, Homo sapiens
  SITE (268): n equals a,t,g, or c
  SITE (284): n equals a,t,g, or c
tgaattttttgccaaacttagtaactctgttaaatatttggaggatttaaagaacatcccagtttgaattcatttcaaactttttaaatttttttgtactatgtttggttttattttccttctgttaatcttttgtattcrcttatgctctcgtacattgagtacttttattccaaaactagtgggttttctctactggaaattttcaataaacctgtcattattgcttactttgattaaaaaaaaaaaaaaaaaaaaaaaaaccccnaggggggggccgggtncccaatcccccccaaa

SEQ ID NO: 144 - DNA, 2243 bp, Homo sapiens
  SITE (929): n equals a,t,g, or c
tgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttycggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagnggctgcccctggcacttcagaacctcttcctctacacttttggtgtgcttctgaatctaggtctgcatgctggcggcggctctggcccaggsctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctwtaactgcataagcaataagatcttaataaagtcttctaggctgtagggtggttcctacaaccacagccaaaaaaaaaaaaaaaaaactcgag

SEQ ID NO: 145 - DNA, 1082 bp, Homo sapiens
  SITE (265): n equals a,t,g, or c
  SITE (354): n equals a,t,g, or c
  SITE (1064): n equals a,t,g, or c
  SITE (1081): n equals a,t,g, or c
gccaagctctaatacgactcactatagggaaagctggtacgcctgcagktaccggttccgggaattcccgggtcgacccacgcgtccgcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacancttgggaatgccatggggtttgataatctgccagggacatgaagaggctcagcttcctgggaccatgactttggctcagctgatcctgnacatgggagaacaaccacatttttctttgtgtgtgcttctagcagctgttcgggaggaccktgacccaayagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatctyctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaataaaaaanaaaaaaaaaaaactcgng

SEQ ID NO: 146 - DNA, 4313 bp, Homo sapiens
  SITE (1126): n equals a,t,g, or c
  SITE (4015): n equals a,t,g, or c
caagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttcctgcacacctgtsgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgnaaggwgagatcaacaatgtgcagtgggcatcaactcagcccgaaytgtcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaakgywkkttttcatgtctcgtccatgtccatgttcgtgttagcactwacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcagtgtctttctgttatgtgaatgagttccatggaggggcatatgtgtgattccaccgttagatgagcccttggggcaggcagtttgggatgtgctcttgggggaaagttggctgtttccttgcgctctgctcctacccgaagtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcntctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaattaaattggccgggcgtgaa

SEQ ID NO: 147 - DNA, 1183 bp, Homo sapiens
  SITE (1053): n equals a,t,g, or c
ggcagagcctcaagctgacttggattatgtggtccctcaaatctaccgacacatgcaggaggagttccggggccggttagagaggaccaaatctcagggtcccctgactgtggctgcttatcakwyggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctangacttcattattcwatrattcaggaccacagtggagtatgatccctaactcctgatttggatgcatctgagggacaagggggkcggtstccgaagtggaataaaataggcgggcgtggtgacttgcacct

SEQ ID NO: 148 - DNA, 734 bp, Homo sapiens
gaattcggcagagtgaagcattagaatgattccaacactgctcttctgcaccatgagaccaacccagggcaagatcccatcccatcacatcagcctacctccctcctggctgctggccakgatgtcgccagcattaccttccactgcctttctccctgggaagcagcacagctgagactgggcaccaggccacctctgttgggacccacaggaaagagtgtggcagcaactgcmtggctgacctttctatcttctctaggctcaggtactgctcctccatgcccatggytgggccgtggggagaagaagctctcatacgccttcccactccctctggtttataggacttcactccctagccaacaggagaggaggcctcctggggtttccccrrggcagtaggtcaaacgacctcatcacagtcttccttcctcttcaagcgtttcatgttgaacacagctctctccrctcccttgtgatttctgagggtcaccactgccarcctcaggcaacatagagagcctcctgttctttctatgcttggtctgactgagcctaaagttgagaaaatgggtgccaaggccagtgccagtgtcttggggcccctttggctctccctcactctctgaggctccagctggtcctgggacatgcagccaggactgtgagtctgggcasgtccaaggcctgcaccttcaagaagtggaataaatgtggcctttgcttctatttaa

SEQ ID NO: 149 - DNA, 1405 bp, Homo sapiens
  SITE (604): n equals a,t,g, or c
  SITE (842): n equals a,t,g, or c
  SITE (1079): n equals a,t,g, or c
  SITE (1334): n equals a,t,g, or c
ggcacagtggaccccagactccctctccgcctttctctgcctggggagacccactgtgtgcatggcatcactgactcccatacctctggctatcaaaggtttctgccatggccaccctggaagsaaaccagagggaggtagacagggagatcaggtcccttctactctggttcctgctctgtgaaattgtctcaggctggctgtgtccagarggtccctggttctctcarggatgccaaatctacaagaatctctcctcttccagttcctataacctctccttccttttgtctctttagaccttggagtagtagcagccaggttctttctatctctgggttagtgcattatctctggtggctcccttacccaggactttgggaatggtctttttgtaatacattctcctcaaataattcaattttgagtgttctgtatgtatcctgctgggaggttgttatatacaaatcactgtgcccgtttagcagagaaggagactgaagctcagggaggttaagtgtctttctctaggtcgtattgtggagaaagtggctgactggggacttgaatgaggtccctagtttcatgctcggagggcaaagangaatgtccaattggcctgagataagcctctggtaaaatgtactgtacataataggtaatcaataaatgttggctgatgacaaacatgttttctttgttcattagttatagtgattatgttctaaataactccmacaaggaartcagcacatttggaatatcawtatctttccatgataatatctttccmyggaaagawaatgatattccmaactgggagtgtcccwagcaratctgantctgtgtattggccctggggtgggccagccccttagactctatggtctcattctctttgtttacaaaattgagataaggccttattctctccccaccccacccatccatattgttttgagaataaaatgagaggatgtgtgtcaagggtgtattttggcaatagtctctgagccattttctgagcacctccatactgttgacactcaagtaatatttcatcagcattccattcaggntcctcccttaatgaggtgtgcgatgtacaagagtygtgaggtggcaaaggatgggctcctgaggaaacacttaggaaactgggctttctgccattaaaagagacaaacctttgtggtgacctaattaaagtttttaaaattcaatttggaaagttagcaagctagctcctktccaggwaaaataaggagtcagtgcatgacctaaccggtcccgggctgcttgccattccaaacaactgcagtaagtttatcacnttctttcagggactgaggtttccaggcacagacttggataaggaaggatgtcctatggggtcacattgatg

SEQ ID NO: 150 - DNA, 2890 bp, Homo sapiens
  SITE (45): n equals a,t,g, or c
ttatatgctacagctacagtaatttcttctccaagcacagagganctttcccaggatcagggggatcgcgcgtcacttgatgctgctgacagtggtcgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattgcacgaaaggagggcaggtatcgagagcccccgcccacccctcccggctacattggaattcccattactgactttccagaagggcactcccatccagccaggaaaccgccggactacaacgtggcccttcagagatcgcggatggtcgcacgatcctccgacacagctgggccttcatccgtacagcagccacatgggcatcccaccagcagcaggcctgtgaacaaacctcagtggcataaaycgaacgagtctgacccgcgcctcgccccytatcagtcccaagggttttccaccgaggaggatgaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgccttaaaagcagcatggggsttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgtttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaaaaaaaaaaaaaaaaaaa

SEQ ID NO: 151 - DNA, 2399 bp, Homo sapiens
  SITE (73): n equals a,t,g, or c
  SITE (90): n equals a,t,g, or c
  SITE (128): n equals a,t,g, or c
  SITE (219): n equals a,t,g, or c
  SITE (255): n equals a,t,g, or c
  SITE (272): n equals a,t,g, or c
  SITE (2354): n equals a,t,g, or c
  SITE (2364): n equals a,t,g, or c
gaacttttccatctggcaaaccggaaactccatccccattaaaccaactcccccttttggtttcccccccagnggaatagaatttggacncccatataaatccaggaaaccacctaaattctttagtngtttgtgtttgcaagatctaaggtcatggtaaacattaagttcttaaaatttttgggagggaccagtgcacctctccctctgaattgttcnccaatttaaaattggagtaaggttttaaaatgtctnattccattggaagggtntgttatttcattttgagcccagaggggagaggcacattttaaatatcagaattagattagctttgagtttgtacaattgggaacataatagattttcataaattatgtgtgccttgttggaagtgtcaactgtctttatgtctgcttgtaaaagtttcaaaatatgttttccctcaaaaaggcaacgttacttcatttgcttgaatattatgataggaatgcttactgatattacttgatagtcatatatagcctaggaaatttaacatatatataactatagcagtattaataatgatagttgtacttctttaaaacattaaatttgaggaaactttaatgctgtctcgtgtacattgctttactacagtgagggggaatatcctttagattgagcctcaatttactggttagtagtatgtgaactctggtataaaaacgtaaactagacagtagagccgatgaattaaaattgtaaattgctacattggcattttctacctccttttctgtcagagtattactttttccagcatttattcttatttgtgagtaaagaggaaatgggaacctgaggttaaaattgacatttttgtttcattgagaatttaagcagtaggtacaggagaagtgacttgtcacattaatttggtgcctaaatctgtaactacaagttgtgatcgacatgtacaaaatgtctaagaaaggtcatatgctgaatattttacttttcctgtatagtctgcatgatttgtttcataaacccagcttatttcctccaaaaagcaaaatggtcctgtaatttttaaagtaaaataaacgtgccattttgtctgcaatctataatttcaggaagttattgraagttctgactcagggctttttaacagttcaagcaattgtcagttatattttggaaactccatctgtgtaattctccagtgccttgaaagaattattaacttggcaacactattaaaactttataaaagatggtctttagtgcacgtgtatcattatatacacgttttaaagtcatattgcttagcttgttaataatgattctgcatgtgtgctgggtttgggtaattctttaaaggaagttttctagatttgcacttgatgtttgttttttaaaaactgattatttatggccgtgacactgttaccagaaaagtaattctaattaagttattatgcaaagtcatctataagtagcatctgggaagaggagatsgaggccacagtttgctattttagtatgaaaggaggatctgtttgggaaacatagattgtcttcccctcaaatgaggggaaaaaaaaagaccctttgttcaaatggattctgttgtaaaaaattatttttaaaggaaatcacaaattgtatgtcattcttaatgctagtcttatagaataaatccataaaattgtttttatgttcagtatgtttatgtcattctaaatgcagcaaattcaatgatagcagttcaattgactcatagcagtgttttgtattttttctaattctttagctttcaatattggattaaagtcttgtttgtgaatatagtttccgtatggcaaatgatttcttgcttattagcttttgttaaagaatgcttagtaagagctaagcttttaaaagtaatgcaaacatttatcgttaataaaacctatggtgtaatatcatataatgcttttctttgatctttggagaattattcttttatagtagtatacatgaattttgatttttaaagcatttaaaaacaaatctcaatacattaaaaaacctgttattgttaaaarggaaattaccatgcctttaagaaacaaggatgtacatcttcaattcagcatragtgtccacatctagaaggctctcattgcagttgtttacagttaaggtacctctatctaaagggccaaagaagcatttcataytttaacacctcacattctttcaggattaagacatatgaaaatagtctgaataggataaatttggataggaagtaacttaaccagtctgggaagattcaggctttttctatkaaaaagcttattcctcttcacaactcnggtggtaggntttcatttttcaagagggtagatattttaaagcca

SEQ ID NO: 152 - DNA, 802 bp, Homo sapiens
  SITE (105): n equals a,t,g, or c
  SITE (730): n equals a,t,g, or c
  SITE (755): n equals a,t,g, or c
  SITE (757): n equals a,t,g, or c
  SITE (777): n equals a,t,g, or c
cgtgcctgtagtaagctcatccctgcctttgagatggtgatgcgtgccaaggacaatgtttaccacctggactgctttgcatgtcagctttgtaatcagagattntgtgttggagacaaatttttcctaaagaataacwtgaycctttgccaracggactacgaggaaggtttaatgaaagaaggttatgcaccccmggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgctyctttgtattgttgcatttagtacaatcagtgtttaaacttactgtatatttatgctttctgtatttaccagctattttaaatgagctgtaactttctagtaaagaattgaaaagcaaatcctcactaaaggatacacaggataggataaagccaagtcncatcaacattaaaaaatactaaaananaaaacacaaaaaaaaaaaancccggggggggcccggaacccattc

SEQ ID NO: 153 - DNA, 461 bp, Homo sapiens
  SITE (77): n equals a,t,g, or c
  SITE (437): n equals a,t,g, or c
ctaggagcaccgagcagcttggctaaaagtaagggtgtcgtgctgatggccctgtgcgcactgacccgcgctctgcnctctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgggaacaaggacagggggatttaagcagtcaaaaggaaaaacatgttaagaccctagacttgtatattgacacacttgtaccttgtaaggcagaggaatgtaattaaaaagcacttatttggcwnaaaaaaaaaaaaaaaaaaaaaaac

SEQ ID NO: 154 - DNA, 2388 bp, Homo sapiens
gcccacgcgtccgaaagcggagaacgctggtgggcctgttgtggagtacgctttggactgagaagcatcgaggctataggacgcagctgttgccatgacggcccaggggggctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttggggccacaggaatctgaggcaacggaagatatatagagtgatcgtccccctgccgaaggaacctggcayctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcaacaagtgtcacgcctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaatcccattgctagatgtgccctttaaaagatggtccagtgctttcagggaaggatgtttagccagttttcctagtatttgttccttaagattttttgacctgtgcttaataagacggacgcgtgggtcgaccc

SEQ ID NO: 155 - DNA, 642 bp, Homo sapiens
aaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgtttttttttttccatgatgtccaattttgttgtgggaaaggatttggataaaatttttgtttaaattttggtagatttttatctatacaaatttaaataaaattatgttttgtaag

SEQ ID NO: 156 - DNA, 1251 bp, Homo sapiens
gccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactgagcatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaaaaaaaaaaccccggggggggcccggtccccaattggccctatgg

SEQ ID NO: 157 - DNA, 2127 bp, Homo sapiens
  SITE (312): n equals a,t,g, or c
  SITE (1212): n equals a,t,g, or c
ccggcgggagagggaagctgcagcgagaggcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagcgcnccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctracacggcccccatcatgagtggccagggcctagcaggcttctttgcctccgtggccatgatctgcgctattgccagtggctcggagctatcagaaagtgccttcggctactttatcacagcctgtgctgtkatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagctggntgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcagagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctccatggaaaaaaaaaaaaaaaaa

SEQ ID NO: 158 - DNA, 1625 bp, Homo sapiens
  SITE (44): n equals a,t,g, or c
  SITE (1066): n equals a,t,g, or c
caaaagatctataatcaggacattgtttatgtaagttggacaanaaaaattcttcccctttatgtccacccttcctatgattgcaagacaaaatttccctcctttacctcatccctataacatgggaggctgagaaaaatgaggggagatggaaccagatacaaggagatccaataagagaagcttatttaaatattgtgaaataaaggaagamccaaagcatttttttaagtggggaatccttttgaacagttattatttatccatattattaayaacatcttttctgacaaaatccatcagatgaagtgtaaatggataatcttttaatggatctaaacctagaaagtttcacttactgttcatgtccgtgttccagaattgtgaaatggtgtgtggttttgctttccaagttcttctctgcctcctcttaattctctaattccatgtcttacagaagaatgagaaatttctttcttacttgagtatcatgctctaaaaaacttggcttcagtcacagaaacgctggctctcctgtgcttatattgaagccaactgcctttaattcttgggccctcttatatttttaaggtgcaaaatttgaagtctcagtcaccagacacaggttctatacaattaatgatgagctggagaagtaatatgtagctaatttttcaaaagcattgaatatactttccggaaagaaaacagaaattaaatattgccacatcttgccagaatcccatctgacaccttaactttgtcaggtttcctacaacttgctaatcaagttttatacattctaaatctccccagtttctttggggctggaagatgcaacttccatttaatagaaactttgaaatcttggggtaagggagcagtggggggactagggagaaggataagaaatagaattattgaaaagcccccaccagggaccttcctggccagaatatgcagagtaattcctgctggcttcacctttgaaagtccctcgaaactatgcagatgaaactgagtctgtttttgatattgtcagatgtattctaccttggaagtcccnacacctaaactggaattcttgtatttacatctcctccactgtcccccacaccacccctcaattcctgctgcccctgctaatgttaagcatttttctcttgttatcatcaggttcacattaaaamcagrtacttacaaactgacttgaagcacagatacttttacgaatgtgataaaatattttcttaagaaaaggaaagaggatgtgggtcaaataaaacaccgcatggatgttgattggtgaatactggtgtaagaaaagggagctcaggaatttttattactgtatttgtaaatgagtttgaaggaatttgtaaatgccactggtacatttttaaggtgacacatttgctccttataaagttattaaaaattacagggtaagcttaaatgacgtttgccagtagttttactttatataatcaatattgatattgttgctgaactatgtaactttatgatgcatttttcagtcccttttcagagcaaatgcttttgcaatggtagtaatgtttagtttaaattgacttaataaattmttacctgagcaaaaaaaaaaa

SEQ ID NO: 159 - DNA, 1687 bp, Homo sapiens
  SITE (334): n equals a,t,g, or c
  SITE (505): n equals a,t,g, or c
  SITE (1044): n equals a,t,g, or c
  SITE (1670): n equals a,t,g, or c
  SITE (1678): n equals a,t,g, or c
  SITE (1683): n equals a,t,g, or c
  SITE (1684): n equals a,t,g, or c
cggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggnatcgaggacgatgccgatgaaggccctggagatcagtcaggcccagctgttatttgagaaccggyggaagggacggcagcagcagcagaagcagcagctgccacagacacccccttcctgtttgaagactgagataatgtctcccctgtaccaagatgaagcccctaaggnaacagaggcttcttcggggacagaagctgccactggccttgaaggggaagaaaaggatggcatctcagacagtgatagcagtactagcaktgaggaagaagagagctgggaaccctccgtggtaagaagcgaascgtgggcctaaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctncagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctraataaaaccaggataatggaaraaaaaaaaaaaaaaaaaaaaagggggggcccntaaagggncccannttt

SEQ ID NO: 160 - DNA, 1842 bp, Homo sapiens
  SITE (19): n equals a,t,g, or c
  SITE (62): n equals a,t,g, or c
  SITE (1793): n equals a,t,g, or c
  SITE (1834): n equals a,t,g, or c
ggatgacagattgcgacanagatttgtgacccttcctgctgaacttcagagggagctgaaancagcgtatgatcaaagacaaaggcagggcgagaacagcactcaccagcagtcagccagcgcatctgtgccccgagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatatttggtacrggctccttttkgtgaayccttaaaaactcaactctaggargcaactactgtttattatactaaarggctgaaaamcctccaggccagactgctaagctctgaaatycctgagaggtctcagaccgggattctacttgttccaagaaagggtaaagcttctaaaccatcttattcttgtctccaagcatgaacacaggagcatgtyaagaaaatctttactactttctyccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctatgctagtggatatttggaactttttcctcaaacaaacaccccacactgacttcagcaaaaccctaaaactagctacagattactactacgaatgaatcatyaagttttgtgtctgcaacaatttagaagcactaagcccaaatatcaggaaatgtgtgtatgatggaattttctaggacaaaacagatcaagattaaaacaggatcaaggattaatggtataaaaatggtctactaaaacaggatcaaggattaaaacaggatcaaggattaatggtataaaaatctctactggttaccgggtggcngggccatacagggtagtggtggatggatagtttagtttggnaagggtaa

SEQ ID NO: 161 - DNA, 770 bp, Homo sapiens
  SITE (744): n equals a,t,g, or c
ggcacgagccctatgctgttcttgtgataatgagtgagtctcacaagatctggtggtgttataggcatctggcatttcccctgctgacgctcattctctatcctgccaccctgggaagaagtgtcttctgtcatgattgtaagtttcctgaggcctccccagctatgtagaactgtgagccaattaaacctcttttctctataaattatccagtcttatatatttcttcatagcagtgtgagaacagataataccgtaaattggtatcacagagagtggggtgttgctataaacacatctgaaaatgttaaagcaaatttggaactgggtaacaggcaaaggctggaacagttkgaagaacagttaagaagaagacaggaaaatatgagaaatcttgaaacttcctagagtcttaaaggtctcagaagacatgaagatgtgggaagctttggaacttcctagagacttgtttgaatggctttgaccaaaatgctgatagtgatatggacaatgaagtccaggctgagcttatccagacagacataagaagctcgctgggaacttgagtaaagatcactcttgctaggcaaagagactggtggccttttttcctctgccctagagatctgtggaaatctgaacctgagagagatgatttagggtatctggcagaagaaatatctaagcggcaaaaccttcmagaggaagcagagcataaacgtttgaaaaatttgcagcctgacnatgggagaccaaagttaaacccaatt

SEQ ID NO: 162 - DNA, 519 bp, Homo sapiens
gaattcggcacgagctgagaggcacaggagcaacagccagtgccccctgcagaggaccactggggtcacagacttcaracctgatgacctgggctcagatcccagctctgcacctaccagccgtgtgacaaggtgtcctctctgagcctcagtcacacactgccttaacggttgggcctcatggagctgtttgtgaaggttaaatgggaagacataaagcacttagcccagagccaaggacatgctgaataggataatggtggcctcctttggcgctgtgctggtgcaggtgtgccgaggaaytgggcaggggtgacagatacctcttctaacctagttcctttccaagaacctaattggtgtctctccctcccccaggcaattggaaggaggaggctgggccccagccccagaatacgggaggtttctcaccgtggtagggaaattgctgggttgggggtgtgggcaaccacagtgatcgtctctctgcaggacggatgaggctttgctgacagaggc

SEQ ID NO: 163 - DNA, 753 bp, Homo sapiens
  SITE (720): n equals a,t,g, or c
  SITE (730): n equals a,t,g, or c
  SITE (736): n equals a,t,g, or c
  SITE (741): n equals a,t,g, or c
ggcacgagcggcacgagcagccagttgctgactggcacatggcctccagcgtcccggctggtgggcacactagagccggagggatcttcttaattggtaaattggatcttgaagcttcactgtttaaatcttttcagtggcttccctttgtacttagaaaaaaatgcaacttcttctgctgggactcatccgctcacagccttcccctccaccctctctctgcctcatgctctgcccctgcctgccatgcctccgatactcaccttttgtaccccagcacccgtgccctctgcccctcgatctttgcctggctggttgctcctcactcagtgttcaggacaaatgctcctggccctaccccatctagccagtctagcccggtcttccctgtcttccctgtttcattcatggctcttattgtttgttwacttgtgtgctgttgacttttaactctctcagtccccactggaatgcaagcgatctcccaagctcctagaattgttcctgcctcttcacaggcccttacgctgtgtgtgctcgtgccgaattcggcacgagggtatgtgcacttgctggtatgtatgtaggtgtttgctaacacatacgtgcacacgcagaatgcttccaggggactgcacagcctctagttcgcagcccccacccctccctttgsccctgcactctcccctctctgagctgcattcgcatgaaagggtgcanggttcctgancccgcnagcgncacctcctggga

SEQ ID NO: 164 - DNA, 1893 bp, Homo sapiens
tcgagtttttttttttttttttttttttktaatttaaacaaataccaaaagctttatttaagcaaaaacacattcaaccacagaacattcagaaagctaacaggatcatttctacattcattctgcaaacagtgtagtaagaaaggtaatttgagaatttccaaagatgttctcgctagccattatttatggtaattacataacattttgatgtcaagttattacagacttaaaagttaatatagcataattttacaatcgtactttcactatgatttttattttaaccctggatattattggtttgaagctaatattatcagtcctattggctgtcactgtcacagatctgaagatatgtttaaattcatcaagctaggaagatatcaaaatattaacaatcttcaagtatagtgagaaaaaaactgatttaagtgttagcatttctaaacttgagactctaacagtaaaaacaaagtaatctgaaacctgtttccatgggtaaaacactctgcctggtattcttgtacacaaaatttactaaatatgtgaatatcataaaatgaaaatatcactcccttcaatttctttggccttcacaaattcaatgtgactatgatccttttcaataatacttycaatgacattgtgcttctttagaaaaatcacttaagttgtagcatacaatagttaacattagttcttttattgctatggtatatgctaatttttttaaaaggggaaaaaaaaacccagagaacttattaaaatgtttgttaaagcaaacatttcagttggtttcctttctttgaagaataatagaaataaatgtcagaggagtattactaaggagccaaaacaaacaaacaaacaaaaaaacaaaaaactcctttattactcccatcctcagaactaactcaagacaagagatctgtattcaaaaagataaaacaatctcatctcagtaactacctcctatgaaacctaagagagaaaacctgtaatagctctcttaaccaacagccccatctgcacatcaccaagcaccagttccctttgggtagcagtaatgcttgtttttcatctttgcatattaaggactgttgttaacagatttatgggtcatttgtagcttactttgcaaatacctttcacttcttatgaaacacaatatgcccccaaacatggaccattattcaagtagacaaaatcactcactgacagcactttaacaacccgcctccactycatcttcccattctctcaccctatgccttccaatgaacctagtctttgctagtgatgagtccatctggggacaaatactgctttaaagatgatgtaattttcaatgccaaccacagtgactttcccataataggtattaataaacacttgttgacatagttataataagctaaaaatagttaacattaattttgctctttatcttttattcttatggcatagaatttattttaaaagactgaaaaactgattccaatgtaataatcacttactgggccacacgctagatgacagacatgcctccctgcctaaaaagggctcaaaggaactctcagttatacatgagtgaattaaaactttaaatgtactacaagaaagaactttttatatgaaggattctttatgtagagtatcttttttgaaaaatcagattttcttatcctatattacactggttttaattgggcatgctcactttagtggtgtgcctcattacaatgtctcttttgtgttaagaattaacttacaaaagcatttaaaaatcactacatcaaatgggatagagagtaagaagacaggagagagaggagaaaccatgttttttcggacgcgtgggtcgacccacgcgtccgcggacgcgtgggc

SEQ ID NO: 165 - DNA, 2153 bp, Homo sapiens
  SITE (101): n equals a,t,g, or c
  SITE (1670): n equals a,t,g, or c
  SITE (2134): n equals a,t,g, or c
  SITE (2135): n equals a,t,g, or c
caggcctcagggcctctggtggctctggcccagacagtatttgcagttcttgtgctatgggtgggagtcttcttcctcaagtttcggcagctgtgctgtgnctggatgggctgctcctcccagggctcaagggctgtggtccgctcagggtctcatttccccaggccaagttcaaggcagcagccctttgtgaggcgctcttggccctgggctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccrtgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagcatgggggcagtagcctttcattagtgtagatagtcattccctggtagggtggagggtaagacatagggtctggaactgtttgggaccttttggggatgtcctgtgcctcccagattcctmgattctgggaggagaggctgccgcattctgctgctcctcacagcgagcaaagctgcacccacttacattcagtattttcctggcactacaaagagtgggaaggcctgggatttgctgctgctcccttagagcagggcccctyttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgntcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtgctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacggaaaaaaaaaaaaaaaaaaaaaaaaaaaaaaaaaactcgagggggggcccgtacccaattaacccnntatgatctataaagcgtc

SEQ ID NO: 166 - DNA, 1251 bp, Homo sapiens
gcccacgcgtccgcccacgcgtccggcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcakaatagatactcaatatgtgaatatgtgtctactagtagttaattggataaactggcagcatccctga

SEQ ID NO: 167 - DNA, 882 bp, Homo sapiens
  SITE (522): n equals a,t,g, or c
  SITE (752): n equals a,t,g, or c
gacsmtctagaactatggtcccccgggactgcaggaattcggcacagcggctgcgggcgcgaggtgaggggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgaytccgatgtcgacgaktttctggacaaktttctcagtgctggcgtgaagcagagtgacyttcccagaaaggagacggagcagccgcctgcgccggggagcatggaggagagcgtgagargctacgactggtccccgcgcgamgcccggcgcacccagaccagggccggcagcargcggancggaggarcgtgctgcggggcttctgcgccaaytccagcctggccttccccaccaaggagcgcgcattcracgacatccccaactcggagctgagccacctgatcgtggacgaccggcacggggccatctactgctacgtgcccaaggtggcctgcaccaactggaagcgcgtratgatcgtgctgagcggaagctgtgcaccgcgtgcgcctaccgcgacccgytgcgntcccgcgcgagcacgtgcacaacgccagcgcgcactgacttcaacaattctggcgccgctacgggaagtctcccccacctcatgaagtcaagctcaagaatacaccaattctttctgcgcgacccttctg

SEQ ID NO: 168 - DNA, 1208 bp, Homo sapiens
  SITE (161): n equals a,t,g, or c
ttcagaggaaaaataagttctgtatatgttttagctaaatagtattatttttgtcatattcccaaattggaagtcccagtacatattagcctattacaattctaagttatttgcagtaaagaatatagatgaagctggtctcatttctattttccaagtknytgggggccatagtgatttttttttaacctgacaacacctcagggaaatttatggtttacagagcacaacattgtaaattatggcaaagtaaaaaagaaaacactgaatttcaacttggaaaatcagaatgctgttgctaatagtattagtagcaaatatattaagtatgtcaaatatgtcaaatgctgttgtaagtgatttacatatattagtacatttaatctcacataaagcaaattaagtaatatcattagctccattctacagatataaagaccgagactcaggtraattaaggtactcacccaaatttacatagcagaactgaaattcaaacttatgcaattagtctccagtctaagattttaactgcactgttattctgtcgctgttacctactaattgggtwacctgtggcaagctattttaccyctctaagtcaagctgtttattgatcagacagattaakgttwtctgawgtggskgtcmtaaggratcagtatttaacagagtcaaatgcagtgcctgaaatatgcagttggtactcataatamttatttattaaatgagaytcaagaactctagatttggttatcytcctagctgtgwamacacagctatttgttacctatcgttattagaggaacaggcataaagctgtgctgagytgcttgacggaaaattcccactctagaacttcaactggatctttagaactaatcattaatcttggatttacccaggttgattgcccattgcaactcataccacaggcatttcacgtactgtatgcattcctcaaaccagggcagggggatcaggaaatgatttaaacccgtcaactgaggagccccaggaggaccatgcactggctgccctgacattttaccaaatgtggctgtcctgtcatgatcttttcttaagaatccctacgtaattccaaagctaatattwaaatatacgtaaatacctctatcttcactctgtatcccttyacttctaggctctggctccatcaaccattccatcatccttttgagtttccc

SEQ ID NO: 169 - DNA, 1258 bp, Homo sapiens
ggcacgagagaaaagaggttgagaatgttttctagcaggcagaatgtgcatacatgttttcatgagtgtcctttgggtgctgtttcttttaaatcctctgtgcacagggctctggcctttagtaaactgtttttctgtcttacgtcatgctgactgggtgctaggggctgattacaaaggggaagagttgaacagacatcaggggccgatgaaaccaaaggactaggagtcaggagaacaagtcagggattaggagacagcggtttggtttattgttatccagctggaggactcctaggggcagcagcaggaggaataccagggccacggaggggccaggagtctcacagtggagggcagactctaacagatgccagctgaacgctcgctggccctggatgtcatacgagttggggaccagaaatctgggctcagagaacccgtccagggagatttgaagccatgggttatcttctagagttgatactgataatatattttaatttttattgatgtttaataccttctgaaacaggagggtaagatcagatgggaagcccctctgttgaaggatcttgggaacttggtggttttttttttttggtttttttttttttgatcgagctgtggacatccttcttaattcgattctgaggatttgtttaactaaaaagttcccaaacacagaaagggcctccccacctgctttggggagctgtctgtgctgggagtgccaggcatcccatgggacccatcactgccagtgtctgtgcctcccagaggtcagccctgtgtctgccctggctctgtctcctctgtgacagggcagagcatttctggtcagtttctccatggtgcctcccaccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaattctaaaaaaaaaaaaaaaaa

SEQ ID NO: 170 - DNA, 1624 bp, Homo sapiens
ggcacgaggtcgccgccgcggccgcctggaattgtgggagttgtgtctgccactcggctgccggaggcgaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacrgagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggccaaaaaaaaaaaaaaaaaaaaaaaaaaaaa

SEQ ID NO: 171 - DNA, 2003 bp, Homo sapiens
  SITE (1961): n equals a,t,g, or c
  SITE (1999): n equals a,t,g, or c
ggcacgagccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaactcgngggggggcccggtacccaattcgccctatagtgagccnattc

SEQ ID NO: 172 - DNA, 786 bp, Homo sapiens
ggcacagcggcacgagaagactttggtgtttaagagattaatgtgttagccagaacaactcatttctctaccmgtgtgtagtccatttatctttaaagattttctattggaataattttgaaattactttcttagttttcttcattaaaaactaagaaaatgctttgtttattatgaattgctatttctcttgattattattcttggagaaagtctatcagacgtaattcttctgatttgcttctaggctagaggaaaatgtgaaagatgacaaatgaaaatttcaaaggttgtcagtagtatgacttcttttatcgtttgtcattatcacaaatatatcaacataggacttttaaaagatattttgtacatattgggccttagtaggattttgcatgaattttttttttcttttatgcccagagagaaagagcaaagaaataaccaagggtgatgtactcgtattgaaggtttaccaaataaggactgcttttattatgaactatagtctatattctaagtaaatcaatttttctattatgtgttttttgttcctgcaggcaagatctctgaactttatgcagagggttcttttaaaaaaacaaagttgaatttttttatttcttggaatattttttttcattgatttctcccaagtagagcagattcaaatctcctttgtaccctatgtcttttttgttttgctattagctcagtattccgtttctacattttcctttcctagaaccagtcaataaatgacaaaaaaaaaaaaaaaaaactcga

SEQ ID NO: 173 - DNA, 1758 bp, Homo sapiens
gggacgagccctgcccacctcctgcagcctcctgcgccccgccgagctggcggatggagctgcgcacggggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaagcttctggaggcccttgcgaggcgtcaacgtcatgatcatgggtgcagggccrgcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttggttgttttgagggagagaggcggggtgggggggtgcaaatctgccagcagctcttacgtaaggcatgttttattggggagggctgagcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagagctatgccctgacctacccctgattctatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtggtgggggagtgggtattacatgcattgctgaagagtcaaaaaaaaaaaaaaaaaactcga

SEQ ID NO: 174 - DNA, 1369 bp, Homo sapiens
ggagccttggtggaattctgcatcatcatctccttttttttttttttttttttttttttttttttcctctgggattatatcagaatacaactgaatgagcgattgggttgatcccggataactgtgtccatgggttatagtagaatcttggccacatgggagactgctattagctactggaggtgctgctggtaaagcaggtgtaaaagaaggcctcactggggactgctggaagctggtcccagaaagatttccatgtccctgcttcacagaagaaaaatttgggcttccaacagggattgatggtgaatcaggaacaaatgaaggagggcctacctgccttcgctcattagtctgcatgaaagtttgggtggagggtgaattaattgatccttgttgtatattctgctgctgtaaaacctgccccatttgctgttggtgttgtggagactgctgaaggggtcctagaggttgcataaaatcacaaggtaagtcggaactgtagaagggaatctgggacacagatgtcctactactacttatctcagagcccaccataccatgctgctccatttccatcctctgctgcaaagctctttgtctatctacctcctgcatgagttggatccgttgtctctcttgctgttctcgtaaacgttccttacgttcccgttcttgaaaactttcactaaagggattgttgtcatcaaattctacccgaggtggtgkstcactctgtggatttgcatttgagactgtccctggggctggtgtacaagtttttattggtaactgggcaattgggggctgaattctaggaggattgaggggcaggtgggcagragcactgttgggttgccatccaggtaaactgggcattctaacagggctagtatggccagaaataactgttgtgtgctgctggtgctgaagctgctgtggcaccatgggaaaggtgggttggctcatggtgggtggagtggcacctggaattaggggtggctggggctggacactgggcatcatggtaggtggggccattgcacattgctgctgctgtttgatccgataatcttcaatcaattcagcatgttctttctgttgtttacgaatctgttctagctgtttctgaaccatgctttgctgttcagtaacatgcttgagttgttctgcatcttcctctggaaattcacgcccagctttcttggcagtacgttgtttagctgaaagggccttcttagattttctgtgagcaccaatttgttcttcaagatacttctgctgcatttgaagcagctgttgggtctcctggrgccactcttcatactgcttacgctgtgaatcattgacaaagccgggaccaaaattt

SEQ ID NO: 175 - DNA, 2379 bp, Homo sapiens
  SITE (44): n equals a,t,g, or c
  SITE (1881): n equals a,t,g, or c
ggcagagctagtgtggactccatccccctggagtgggatcacgnctatgacctcagtcgggacctggagtctgcaatgtccagagctctgccctctgaggatgaagaaggtcaggatgacaaagatttctacctccggggagctgttgscttatcaggggaccacagtgccctagagtcacagatccgacaactgggcaaagcctggatgatagccgctttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtsgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccayatcaggaaggagcaccccaaacagacagaaaacgccacgaggcaagtgtagtctctcacagcctggaccctctgtcagcagtccacatagcaggtccacaaaaggtggctccgattcctccctttctgagccarggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccmtcggtgtggcagctttagcctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggccnattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaagatatttatgtatgtacagtttgctaaagccaagttttgtttgtattgatttctttgcatttattatagatattataaaataaaaaaaaaaaaaaaaaaactcgagggggggcccggtacccaattcgccctatagtgag

SEQ ID NO: 176 - DNA, 1348 bp, Homo sapiens
  SITE (407): n equals a,t,g, or c
  SITE (408): n equals a,t,g, or c
  SITE (1331): n equals a,t,g, or c
gcgccttcacgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggaggtgaggggcaggggtggggaccgctatgcccagggtccctcaaagtgctggaggggctgtracttggtggggagtgggtctgtcacagccatcctctgtccagggtggggcaaggcctgggacagtgccaggcaccccaggaccccttccaggcttgtctcctgctccaccgcctcaacaccccccacccctgcccaagctgtttctcctctgcctctctnnttccctgccccaggacttctctcttctcctctgcctctccttggacccctgcccttcctctacctctgacctgtgaacacacagacacatgctcacacactaagtcccargcacacmsaaaggcaatgtggaccagcacaaacctccactctcccggctccatcccarcgggcctgtggctggccatgaaaactgggggctacctggagggaagcatcctcatcccaggtgagtgggcaccagcccttccctgtatgtgtgttgtgggtggaagcaggcatgagagcatcttagcccataggtttgtattcagggacttccaaacccagacctacaaagagtgtgtcttctaccagatcttgttcaaaaaagggtttgtgatgatggaactacacgatagagggagtgagcaagaacaatgaggattagagtggagcgtgaaatagtctaggagcatggcttccaaaacatatgctgtgaggtctgtccacctgagagttgggccatggatttaattctgagcctcttagcaggcaaagcaaagacagaaagcagatcggctgtggatttctgtctataaaatgtgagttcttggccgggtgcggtggctcacgcctgtaatcccggcgctttgggaggccagggcggatgggtcgcgaggtcaggaggttggaaaccatcctggccggaatggtgaagccctgactctactagaagtgcaaagattggctgggtgtggtggcgtgcgcctgtggtcccagcttctcgggaggctgaggcgggagagttgcttgggcctgggaggccgaggttgcggtgagctgagatcctgccattgcacttcagcctgggcacagagccagactctggctcaaaaaaaaaaaaaaaaaaaactcgaggggggcccgtacccaattcgccgnatatgatcgtaaacaat

SEQ ID NO: 177 - DNA, 1502 bp, Homo sapiens
  SITE (446): n equals a,t,g, or c
  SITE (470): n equals a,t,g, or c
  SITE (1024): n equals a,t,g, or c
ctcaaaataaataaataaataaaaatttgtattccattgatttgggtagacaccaggaatgtgcatttctaacaagctttccaggcgatcctatagtaagtcatctgtggactactttaagaaactcttctatagagaatggagttggattaataataggtgattttttacactggactgattcacaagaacctaaacagtagtccatgaagctgctcatctgtggtaactatttggccccgtctcactctgaaagcagcaggagatgttgtttactttgtttctatcccctttgtctggagattaattttggaatgaaagtttttctctctatgccattcctggttcttttccaaagcctcatacaagaggattaggtcacaatgcatgcattaccttttaaaagaatgcgatattgataccgatgcttactttttttttttttnactacttgttttattccttc[450 bp omitted]cttccttggtatagtggaggatttgaggattggaatatagagtagagtgcttgcttaagcctgggagcccatctttatagctatttgatgtaagaaaagagacatggnccatttctaaactatataaggtgagtgtgtctattcccagcagatataaaggaaaaaggaaacttttttgattcccaccttcccagcctcacctagccatcttccagcctcaaatatagagatgttagtgcaaggtcctgggctctaggtgatcatttcataagtcctttacagataaagaaaaagtagtgtttgtatgtttgtttttaagtaaccccaaaacaaatttatattgtattcagcaaaattggaattcaggtgtttaattttagaacatgaagtgcctgctgttttaagcattgacttgtataaaaagaattgcatgtctccagtaagcttatgggttttctcatttttaggtatatggcttttaatcatgtaaagtgaaacattagttttcttgcattttattacaggttctttgttgcaataaagatgctgctgaaattaattgaaaaaaaaaaaaaaaaaaactcga

SEQ ID NO: 178 - DNA, 1637 bp, Homo sapiens
attttctagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcmaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactgaagataccatcccacggaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaaaaaaaaaaaaaaaaaaaaaaaaaaaaaaaaaaaaaaaaaaaaaaaaaaaaaaaaa

SEQ ID NO: 179 - DNA, 2911 bp, Homo sapiens
  SITE (622): n equals a,t,g, or c
ggtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagangcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaaatgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaargcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaacctaaaaaaaaaaaaaaaaaaaactcgag

SEQ ID NO: 180 - DNA, 519 bp, Homo sapiens
ggcacgagccccaggccagccagggccaggcctactttggccacccttaaattagaatgtggggtcaggggtcacagaaaagccatttctctgacctagtgtttggcgtccgggaactctgtgcccaaccttcagaccctggcagtcctcactgaggccattggcccagagcccgccatcccccgaracccccgggagccgcctgttgccacgtccacacctgccacaccctctgccgggccccagcccctcccaaccgggaccgtgctggtccctgggggtcctgccccaccttgccttggggaggcatgggccctcctcctcccaccctgccggccgtcactcacctcttgcttctggtcccccaggcctagcccttggaaggagacaggagtctagggaggctgaagcccactcccggggaggcccgtgctcctccagccccagggacagcaaggaaaagagaagagagcagagcatttcatggctctaataaaaaaaaaaaaaaaaaaaactcga

SEQ ID NO: 181 - DNA, 968 bp, Homo sapiens
  SITE (35): n equals a,t,g, or c
  SITE (45): n equals a,t,g, or c
  SITE (135): n equals a,t,g, or c
tccccttggggccggaaaaagcggggttggcctgnccattggttntccatgccgcccgcccatgccccagtactagcctgcagtcccaatgtagcccctccctcytccmagagcccytcmaaccgccccgstcanttgtgatttcaggaggatttgatgaagatgttaaagcgaaagtggagaaccttctcgggatttccagcctggaaaaaacggaccctgttaggcaagcaccctgcagccctccctgtccccttcttcccctccccttcycccgcccgtggagacagctgttytcagcagggctctccgcagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaarctctgctgcaggacctcagcgaggtgtctgcccccccgctgccacccaccagccctggcagggacgttgctcaggacccctgaggggagagctcatgccagggggctcctgctggaggctgggggggctctgcwytkycwwwtggcctgggcaatacggcccacgtgggcgtcgtgccctctggcccagcagtgtcttgcccacactcagttcctgagggccctgggcagcccctgggggagagactagaaaacacagaaggaagcagcacagggagacccgctttgtgatctgcatgtgtgacactgattctttggaaataaagagtggaagctg

SEQ ID NO: 182 - DNA, 1128 bp, Homo sapiens
tgtaaaagttatcagtaatcctaattcttttcctgggttttccttttgtcacttattaatcagtttttgaaaggacgaatgaatttagagatgtactctggagcagtatcatgttaaaccaggggtatattagaaaaatcatcctcataatcattctgggaagtttttcctccccaaaaaaagccatcctgatgggttttcaaaaccagaaaaaagctcttaatgaggaacagaccactggagtacccatgagcatctcaggaaaactgagaccctcgagaagccttgatttcgtgcaacccccaaggtttcagagccagcagcccagtgctgtggttgacagacgtggttttktggrgaaagcagccagaggccaggaattttcagagtcgtgagtcacgrtytcccacccaagattagagcamagattagccatactgagatttggtaaaatcattctgtctaagcaatggaggtgtgtgcamacgtgcagtgcctgttcacaggggatgcaggcagatcsygggtttaggatggggraggccaccgcacccccyttcaytgctctgcacctgctccctcacgtggacactgtccacaactgtggctctcacaggacagttgcccaaggagctcatatcttattggagatagggggtcgtacaggtgacattcatgagcagtgtgagccgggtgacatgggggtgtcaacccagcatctgtccaggagctcctcctgcagcggctctggcaggtggcctgaggctcctttttgagagagaactgtttggccttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaaaaaaaaaaaaaaaaaaaaaactcga

SEQ ID NO: 183 - DNA, 2276 bp, Homo sapiens
ccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctaaaaaaaaaaaaaaaaaaaaaaaaaaaaaaaaaaaaaaaaaaaaaaaaaaaaaaaaaaaaaaaaaaaa

SEQ ID NO: 184 - DNA, 3374 bp, Homo sapiens
ggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgtaaaaaaaaaaaaaaaaaaaaaaaaaaaacccccggggggggcccc

SEQ ID NO: 185 - DNA, 1337 bp, Homo sapiens
  SITE (1337): n equals a,t,g, or c
cttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggyccctggmagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctrttaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctcttaaaaaaaaaaaaaaaaaccccgggggggggcccggn

SEQ ID NO: 186 - DNA, 941 bp, Homo sapiens
ggcacgagcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaaccygctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgytaagacaaaaagtaaagcactgtggtctttgcaaaaaaaaaaaaaaaaaaaaaaaaaaaaaaaaaaaaaaaaaaaaaaaaaaaaaaactcga

SEQ ID NO: 187 - DNA, 678 bp, Homo sapiens
ggcacgaggcagcttgtgctttaaaggaggtgttcaaagcatgtctgagcagagacttttgggctctgttttaattaatactttaaaataattcatatttaaaatatcagatgtttccataaagaggaggatgtttaaatgcctccagactacattcctttttattcttgattttacctgggagtccaaagttcaattccataaagcaagcgtttatttgtcactttcaatatacatcgattgccatgcttaagatgcaatatgggctgcggaaataggttaacccacaggctcccagggcccagtgtagaaggtgagagattcgtgtaaaatgattcaaataaaaggaagaccctggccgggtgccgtagctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgcagtgagctgagatcgcgccacagcactccagcctgggtgacagggtgagactctgtctcaaaaaaaaaaataaataaataaagtaaaaaaaaaaaaaaaaa

SEQ ID NO: 188 - DNA, 1848 bp, Homo sapiens
gaaactggaccggagaaccggagcgaagcgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggcatcttgaagatgaagaactgccagcatgcgaatgctgaacgtcctactgttgctcggatctccatctgtgcagttccatcccggtgcacagattgtgatggttgctgggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaaaaaaaaaaaaaaaaaaaaaaaaaaaaaaaaactcga

SEQ ID NO: 189 - DNA, 1292 bp, Homo sapiens
gctgccttgctccacacctggtcaggggagagaggggaaagccaagggaagggacctaactgaaaacaaacaagctgggagaagcaggaatctgcgctcgggttccgcagatgcagaggttgaggtggctgcgggactggaagtcatcgggcagaggtctcacagcarccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgyctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagsccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgaaaaaraaaaaaaaaaaaaactcga

SEQ ID NO: 190 - DNA, 906 bp, Homo sapiens
  SITE (144): n equals a,t,g, or c
  SITE (145): n equals a,t,g, or c
actccctcacccaggtcccagccctgggaaccacctaccgtgagcccttttgcagatatagactcatttcatcctcagatggtccttcaaggtaggtactttagtcccattttagagatgagacgattgaggccagaggggtgnngtaacttgcctgggggctcacgagcacaaaaggagccgaggcaggatctgacccttgttctctggcctcactgccctcactttgccatgacccgaagttatgtccctacaaagcaatgcatggtccaaggytctttttattgtatttttatttttaagggtcctgttcaaaactggtgtgagctctgaggagtcctgaaccctgggtgcagcatcctagcatcctgggagtccttttctgcccacactgagctgggctcctcgaggggtggggctgctgtccctggaagcctggcagcagcactgtatcgggttggctgaagctgarcgccgtggggtgcagggctccmggaatccccgtttggctgaaggggttccctgtagccmgggatgtttatgaggtctctctgatgccccaggcgcaggacatgtgtgcgggtggagaaaagcaggccctttcagtgccagctccactcaatttctatgtggaccaagaacgataaacttaaaaaattttttttcctaaggtatcttcagaatatggtgtatttttatgtggaaaagaaaagttatgaaggcagctgttactttaagagaaaattcattaaaagtcctcgaggtatgaagatgacggcgtgcttctcaatcattttggcataacttgattgtggctgtaatttttttttttttttttgtcaagcatgtcagacaataaagtctttgtaaaaagrgaaaaaaaaaaaaaaaaaaaaaaaaactcga

SEQ ID NO: 191 - DNA, 1941 bp, Homo sapiens
  SITE (561): n equals a,t,g, or c
  SITE (1414): n equals a,t,g, or c
  SITE (1422): n equals a,t,g, or c
  SITE (1427): n equals a,t,g, or c
cttcagctgaagcccagggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaaytagtgtggacatgatgcggcgggctgcccgcgcgctgcttgccttggccaaggtggacgagaaccactcagagtttactctgtacgaatcacggctgttggacatctcggtatcaccgttgatgaactcaktggtttcacaagtcatttgtgatgtactgtttttgnattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcgnctacgtcnawcgntgtgtatatatatgacgtkgtacattgcacatacccttggatccccacagttkggtcctcctcccagctacccctttatagtatgacgagttaacaagttggtgacctgcacaaagcgagacacagctatttaatctcttgcccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaagactttaaaaaaaaaa

SEQ ID NO: 192 - DNA, 2118 bp, Homo sapiens
  SITE (13): n equals a,t,g, or c
  SITE (1324): n equals a,t,g, or c
  SITE (1643): n equals a,t,g, or c
aaataataataanaataaataaaaatwaagtgcttaktgtaactcagcggacagggctcccagctgctctggcacgtgggacaccytccaccctgcacacaacaggcatgcaaagaggactggatatggtggggtagagtgcttctggtgtgttcactttaagaaaacatctgccaagagagaagagtgcccaggaaagaccaggaaaatacaagtacatggctgcttcataccatataccccaattctttaaagcagcaaaaggcactttttttttcaggccagagtgaatctaaaacaaacctggctttgcttacagggaagctgtcccagaaggactgagtgatgcctcttgttccctaaggtctggagagtctttgcaagtttccaacgacatttccaaccaggtgggagagaccagcagttgacgagacaagtcagacccaaaaaacgacgccaaggtagtgagtgggtgcctatttgggagtaggatgatttgaggaaaacaggaagaaaaaccggtcagaaagtggcactttggaagtggaaagctgtttgcaaatagcaactctggctaaagcgaaaatgttaatcaagtagaaagtaaaattcaggatcttagaagctcatccttctgatgagaactatttttttttccgtgaaggaactattattactttaaaagtgagggtaatttacatatggggtgtatatattctaaaaatagtaataaaagtaccttttataagcaatgttgtgtggcttgtagaagaaagcagggaggaaaaaaaggcaggcaaaactagtctaggtctaggccctaaaaatgagcttccttcccacttgactggaaacgcccatgtgatttctaggctgaaaataggtaggatttaacgagtaacctagttcccttctgtctctgatttctgatcagctgatggagctgctagtaagaggggccgatcatgctcccagacgagtcctttggcctcttgctctccatcccaagcctgactccttcagcagcagccccctccttctgtgtccatctgatgcaggcaagcaggagcagtaagagggcatcccatgttccagttcaccttctatggggtgactargaggttcccggtaactagggcagcccargcccagcaggttgcaaaagcagctgcaagcttcagaaacccacttcctccaacaccagggaggtggcagagagcccatccaaaagcccactgggagaggcataagattctgtgccaggcccccaggtcccctctgtgtcaggtaggctctgctactggcctctgaagtaaaggcaaanacaaacgggcagggcagggtggcaggaataaaaaactctggacagaaacccttttaataaaggaaattccacccctcccaatccttccatggaagggtgagaccttaatgtgatgtaagaggaaggtcttctctggctttcagggaaacagctgcagctgaaacttaggggcccattccagggcacttttcaccacagccagtgcagccgctccaagtgccactgtcagccccatcactgccaatttcacaaagcggttggtccttggcttggtcaggacatcttttgttcgatcttcaggccgcagaagtccccgaanaccgctgccgcagcaccatatcaggcctctgctgggctgatgccagctcaaagtctttgaaagtagaggctgccgtcctctcagcttgctgttgggcagcggcctcccgagcaagttcggatgggggaaactgaacaaaaaggtctcctstctgctgatcagtgtctcatagggcaagtcctgagggatctgggacaacaggtggtggaccgaggccatgtcacagtcacagtccaggacttcctgctcgcgatacaacacaatcacggctgcaaagtaaatcggcatcagtgggtggcaggccaggaagaagtcatataaccgcacgacgtgcctgaagtcagacaggacatgcccaaaccaggtgatgagccagctgagggcaaagatggtccctacctcagcactctgcatgaagtcatggagctctggattcacctggtcaatgatgggcatcagatagtttaatatatgc

SEQ ID NO: 193 - DNA, 1538 bp, Homo sapiens
  SITE (112): n equals a,t,g, or c
  SITE (147): n equals a,t,g, or c
ccgggttcggctctgtgtcagcagccgggcggcgctcgggcgggacatggcagcctgtacagcccggcggcctggccgtgggcagccgctggtggtcccggtcgctgactgnggcccggtggccaaggccgctctgtgcgcggccgnagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtrtgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcasgyttggccaaaaaaaaaaaaaaaaaaaaaaaaaaaaaaaaaaaaaaaaaaaaaaaaaaaaaaactcga

SEQ ID NO: 194 - DNA, 1098 bp, Homo sapiens
  SITE (283): n equals a,t,g, or c
  SITE (301): n equals a,t,g, or c
  SITE (349): n equals a,t,g, or c
  SITE (438): n equals a,t,g, or c
agaccctgtctcaaataataataataataataatcttattttggagaataaagagacctstggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttnctaccacaccctttcttngccccccgcctcccatgtctgctgtgcctttgtactcagcaattcttngtttgctcccattatcttccagccggatacagagtgaatagttaaccacacttaggtcaaataggatctaaatttttgttcctgctccngtgtaaagaggccagtgtttgtgtgttgcaagcagccttggaatagtaactcttctcatttgtttgggatctggccamcaagttccagaatgatacacggatcagtgcagaagttcatcaggctctcggaccttagggctgttggagaaggcttcagcagcagaactgatggtkawkgytcgtgttctccatcctcaactttctttgcttcgatcatacacaagaatacatttggaagggcaaaaaatgaacactgttgttcattgcagccgtgttttgtgacacagatgcacagtctgctgtgaagaccttctctcaagtggsatytgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcaaaaaaaaaaaaaaaaaactacgtag

SEQ ID NO: 195 - DNA, 1001 bp, Homo sapiens
gaattcggcacgagatagcttgcatctcatcccagtaaaaccacttatttataacatatcaacgtattgacaaggttgaagagcaagattgttctgaggtgagatgcaaatttcaaaggggtgagcactaattgttccagtgattgtttatttattggctaggacataattactctctttgaggttacacatctgcctccaggttcctgtgtgcttgtgcccttgggatcaggccagggcagactgtgatcactgagattcaaactcccagartaatcagcaagagctttctagagaccaaggccaggcctgatccctgagggatgcatgagaaggcttggaatctcattctgctatggtggctctctcttgatcttcttggagtagcaaaaacagcaatgtgggcccaatggtgtggcctaaatgatcacaaaggtaaatgagtaaagggctcagcagatgagtaaggagccttgtcctgagaaattagcactgggctctgcattcagaaacatgtgataagcattgcccattgcacattgcctttattgtgtaaggacatgaaattccagttttgcatagctagtgatgaatacctgaagggaattgcagacatattttattttatttttaattgacagatggaattgtatatatttatcatgtacataatcatgctttaaaatatgtacattatggaatggctaaatcaaactaacctaggcattatctcatataattgtcatttttgtggcgagaagactaaaaatctaccctttcagcatttttaaagaatacaatgtgttttattaacaacagtcaccatttggtacactagatctcttgaacttcttcctcttatctaactgagatcttgtaacctttgataacagctcccaagcccttccccaaccactgctccacccgtggtaaccaccattctattctcaacttcctggtaatcaccattctagacacagggaagactctctaccctctga

SEQ ID NO: 196 - DNA, 1458 bp, Homo sapiens
ggcacgagataaactgaaataggtcatgcaaatataaaatattatttttaaattatttgtcataagaaacgatggtggccatattttgctttaataatggaaaaaatgtggttagcattctgtggaaggtggtcatcagatagtagacattttctaggatttatttctacctgcatatgtggaaatgtgtactactttagatttatttaatggcagctaactcagaggcatcaaaatgtgctaatggtgtaatatggcctttgtcttgctgttctgttttgtaggccttcaatcaagcagggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggtgagtgcaagggagtagaaatctgcatcagcacatcagcacttggggatctaagtaaacctctcggggaaaatgaccaagtggatgtcatctcccagctgtttctaagagcccagatgtccagagtattgtctcaccttgatccctcaggccagaagacctgtgaaaaagccacactggttcagggactcactggacggttttgtgtccactctaacctgcaccgtctctaccccagagtggactcaaatcctcaagtcagtcctctgaacattgaagtcagaaattataaaagggctttggcaatatgttagcccaagaatttggcttcttccagaaattgtgccgaccttaacagtggcttaaatgatggtaaaacttttaagatttctaaaaggatggcattggagatacgttgacttttattaaacaacctatagttgtttaatgacttctaaaaaaatatctggagctcaggggttcaactgagggaacacatgttgagaatcattgtttactaattaaatgccaggtaaccgttgaaattatcaaaaacatcttccacgtaccagaaagcactcagaggatagttctgttatggagaagatgaaatggtttagtagtgtaggaactatggaaaggtgagcttagatttggatagtaaaacctcaagaccctatttaaaaagtattttatgaatgcagcataaataatttaattcagtgttaaatgccaaggctagtatattgagctgaatgtgaaaagaaactcacattgggagaatgccaccttttccttataagatagctttgaagataccattttagacagatggaaattgaatagctttagaaaaggcaaatgtttgatcttggggaaaaaaaaaaaaaaaaa

SEQ ID NO: 197 - DNA, 1282 bp, Homo sapiens
  SITE (675): n equals a,t,g, or c
  SITE (1195): n equals a,t,g, or c
gaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattncttgtctcttcggaagctaacaccatgctataataggcactaaatagatgtctaaaaacaccttaagtatttgtctagaaatctggtgcattgtccagaaagaaccaaaattcmaaataatttcaaagggcctaaagcactakttaatcmaaattcattagtttttaatggtactaccactctcaaatttaaaatgtcatcttacgttcctcttcctcgcattggatttattgctaaaacctggtaaacactttaatccytttcaattccattaccactgctcttgtccagaattactcgcagactaatagtcacctgacttctccccctgcatcccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattngctcactttatacaccaccccccatgccacatcaaattaaattatcctgataaatgcaactgcaaaaaaaaaaaaaaaaaaactcga

SEQ ID NO: 198 - DNA, 951 bp, Homo sapiens
atttcggaacgaggactgaagtgggagcggcggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattcaaaaaaaaaaaaaaaaaaactcga

SEQ ID NO: 199 - DNA, 1740 bp, Homo sapiens
  SITE (1310): n equals a,t,g, or c
  SITE (1736): n equals a,t,g, or c
  SITE (1737): n equals a,t,g, or c
ttattataataatgatgatgattccaaggaaaaaacctacagcgaatgttccatttctaccccgcacgcagacactctccctaacactgataacctgagcccccagcactggacggaagaatgctggcgtctccgtgtgtactggttcagggttctggccccagccttgtcaggaccccctggtgtccagagcccccacccctcccgcaacaagcagctgatgccccagtgattctctatacatttttcacctcggccaatatgtccaggaaaactgcttacttctcttttcttgcctggagccttcattgttcacccttacgttgcaatataggaattaatgctacaaaataaaagtaaagcttacctgaaaagtgcatagtttggggcaatggtatctacatctcccactgtgggaaaaccagcaaagcatcaaaactctcaattctcctgttaccraatgcagatctgaattataagatgtttatgtttgaccattgtttcaacaatgggattttgttacgaattatccctttaactgaaaccctcagttttactgtttacattattaggaaaacagggatatcttttgaatctaaaaatttgatgtacagcatgtgatttttgaagtttacatgtaaagtcacagtataggtgaaataacgtttgtcatattttgagacgtatcctgcagccatgtttttacgtgagtgttttagtcaaagtacatggtagacagtctttcacaataaaaggaaaaggattttttttcctccaaatgtacatttatcaacctaatgattgatttttttaaaaagagatttcgccccagtctggtttatgaaagttcattgccctaaactgtgctgattgtttttaatcaagttataaatttccaacctagatcatgtatctaccaactctcctgcattttccaaaaggcattgagcttaaatattagtcttgcttagagtaggttatccacttacatgctgcgctaaagccatgcctttgaaactccttgtttaaaacatgatatgatttttgtgggcagtttcagaaaagaaaacaaacaaacaaaaatcgaccctttaattattacttgcaactcaacagatctccctgccgtactgccttttccaggaactttacttcagggctgtccagattgcagttgtgccccgtgtatgtggatctagttcacagagtctttggaagccagcagtcgtgccctccgtatactgtccactcattttatgtagatttggtatcctcagcagccagtgttaacaccactgtcacgtagttancagattcatcttttatgtatttaaagtaatccatactatgatttggtttttccctgcaccattaattctggcatcagatcagtttttgtgttgtgaagttctactgtggtttgacccaagaccacaaccatgagaccctgaagtaaagataaggtacacatacattatttgagtaactgtttccttgggggccaatctgtgtatgcttttagaagtttacagaatgcttttatttttgtctataacaaacagtctgtcatttatttctgttgataaaccatttggacagagtgaggacgtttgccctgttatctcctagtgctaacaatacactccagtcatgagccgggctttacaaataaagcacttttgatgactcamaaaaaaaaaaaaaaaaamcycgggggggggccggtaacccatttnnccc

SEQ ID NO: 200 - DNA, 1707 bp, Homo sapiens
gcttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgttttttygagatcacgytactgggctc

SEQ ID NO: 201 - DNA, 779 bp, Homo sapiens
ctgtccccagtgtttccaggtaatgacttggcactccagagaaagtttcatrctgttgcgtgtggtggctccaagccaagcacctggcatgcaggtcagcccttcccagcgggcgtggcgtcgtcctcttcacagatgccacgttgcagccccaaggcctcaccattttgcgttttttagaaacccattttcttggtcatttataaagctgctttatagatatctttgatcctggcatgccttggtttcctctcccttccctctttccaatcctggtttcctaacctcctcttgtagtaattctcaactcaactcaaagtcccaagaatttggaatggtaggatgctgtgcggggagctcgaggctgaggcataatcactgcttcggttctgctcatcaggggacacgctcccttactcatggcagccatgtttgattgtcacagagccccccgaatactctgtctatagtgacacactgtaggtgtcataaattttaagaaacctgcttttaagtactatttataggtttttctgttatacttgcaacctagttttaaaatacatgaggattttatgaaagctttatacagacatttataggaaactcattctttgattttaggtgccatttaaattgataacacttactttataaaaagatgctttttgtctggatagagccttatagtttaaaatatcttcatatattgccatttgatcaaataaatttcttacttagaaaaaaaaaaaaaaaaaaaaaaaaaaaaaaaaactcga

SEQ ID NO: 202 - DNA, 1617 bp, Homo sapiens
ggcacagctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacacatggccaactacccgcagcctgggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggcacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttgaaaaaaaaaaaaaaaaaawctcgaccgcaagggaat

SEQ ID NO: 203 - DNA, 1974 bp, Homo sapiens
gaattcggcacgaggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcgcaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttsccctccaggactagagggagagcagtgtgaaatcagcaaatgcccacaaccctgtcgaaatggaggtaaatgcattggtaaaagcaaatgtaagtkttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctga

SEQ ID NO: 204 - DNA, 1057 bp, Homo sapiens
  SITE (31): n equals a,t,g, or c
  SITE (50): n equals a,t,g, or c
  SITE (132): n equals a,t,g, or c
  SITE (751): n equals a,t,g, or c
cggccttccggggcaaccgttcgtcccaacncgggaaagggtcctggagncgggaactaggagcctcggaagtccaagggcggagcgccctttgctaataagccaatcagaacgtgagacgctccggtgggncggtgccgtcgagcgcggggtggagtctgggtgacttggctggcgggatcaagtgcagctgcttcaggctgaggtggcagatagtgagcgctggtggcggagttaaagtyaaagcaggagagtaatwatgaatagcgcagcgggattctcacacctagaccgtcgcgagcgggttctcaagttaggggagagtttcgagaagcagccgcgctgcgcttccacactgtgcgctatgacttcaaacctgcttctattgacacttcttctgaaggataccttgagkttggcgaagktgaacagktgaccatwactctgccmaatatagaaagttgaaggaagcagtaaaattcagtatcgtaaagaacaacagcaacaacaatgtggaattcasccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggnaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaaaaaaaaaaaaaaaaactcga

SEQ ID NO: 205 - DNA, 721 bp, Homo sapiens
  SITE (264): n equals a,t,g, or c
  SITE (340): n equals a,t,g, or c
gaattcggcacgagtcatccctctccctctttcactcccttactcttactctgttttttgtgctccagacagacagaccctacctcttttgcttcttttttgtttgtttgttttgagatggagtgtcgctcttgttgcccaggctggagtgcagtggcgcaatctcggctcaccacaacctctgcctcccgggttcaagcaattctcctgcctcagcctcccgagaagctggggattacaggcatgcgccaccacacccagctnaattttatatttttagtagagatggtgtttctccatgttggtcaggctggcctcaaactcccaacctcaggtgatnccgcctgctttggcctccccaaagtgctgggattacaggcgtgagccactgcgcccagcctcttttgctcctttatactcattaactcacgcctgtaatccctgttttgggaggccaaagtgagaaggttgcttgaggccaagagtttgagactagcctgggcaacacagcaagatgccatctttataataaaaataaaaataaaaatcaattagctgggcatggtggaacgcacctgtagtcccagccaattgagaggctgaagtgggaggatcattgagcccaggagttgaggttgcagtgagccatgatcatgtcactacactcagcctgggcaatagagggacatgttgtctctaaaaaaaaaaaaaaaaaactcga

SEQ ID NO: 206 - DNA, 2465 bp, Homo sapiens
ccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaatttaaaaaaaaaaaaaaaaaaaactcga

SEQ ID NO: 207 - DNA, 1480 bp, Homo sapiens
gaattcggcacgagctcaagctggcaggtggtcgggggagcggccggagaggagctgccgggagttcgtgccctgcaggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggctttttttttttttagaaagttagaattgtttttaccaagagtctatgtggggcttgattcacccttcatccattggctggaacatggattggggatttgatagaaaaataaaccctgcttttgattcaaaaaaaaaaaaaaaawaaaaaaaactcga

SEQ ID NO: 208 - DNA, 872 bp, Homo sapiens
  SITE (422): n equals a,t,g, or c
  SITE (847): n equals a,t,g, or c
  SITE (856): n equals a,t,g, or c
  SITE (872): n equals a,t,g, or c
cagtatttccctcagtactgtaagcaaaagtggtatgtttttctttctttatgtctactctgtcctctgtggccttctggtgtacccctctcttcctagccattcagtctctctagtcacctccctagtagctagtgctctctaagtttttatttaattagaacaactccatttccatttcaaggtaggtcaatggggggaaaagcctcatgatttaaactgaagttaacaacacagcttttaaaatgaaaactcatactccaacttctaaagtatatttgagctgatttgtttccaaaacaaagatatgctgtacctaaaactgctaaaacaaaaatataaagacaaggactaggtgattaaggggagagaaaaatcatytcttttccaggaaacctttgctaaaataagcaaaacttgantctatgcttcatggaaactgacacaaagaaaagaaactgatggattgcacaggccttgttatagaaatagatctataaaaagatctgtccacaggaaatatacaccttctcctggttctgaacttcaatggggatttgtcacctaggtctccatctataggaataccttcacatacctatctattcatgcacatattctgaaaacaggtacatacaaaattacaacaaaggaaaaaaattctattgaacacttaaaaatagaaacaggccaggcacggtggctcatgctgtaatcccaacaatttgggaggctgaggctggtggatcacctgaggtcaggagtgtgagaccagcttggccaacatggtgaaaccccgtcactactaaaaatacaaaaaaaattagcctgtgtggtggcacactcntacaatccnggctgactcgggaaan

SEQ ID NO: 209 - DNA, 1779 bp, Homo sapiens
aattgccaagactgcacaaaattacagtgctaatgtatatggttgcagttcacataaagacaaaagcatctgttatgaaatgagtagtaatattgggtggttgatttgttcttagcagacttggcttcatwttggtcttgagataaaatggccagcataaatgctgtttatattcacgttttcctaggtgtgtgtgtgcaggccacagcagcatgcccttggtgtagtcagtgccgaaasgggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgktcatcacatttaaaattggragagaacgcgcttgakggatagagcgccttcagkgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatcaa

SEQ ID NO: 210 - DNA, 2110 bp, Homo sapiens
  SITE (750): n equals a,t,g, or c
gcggccgctgcagcccggagctgagctagccgtccgagccgagccgtccgagccggggaagccggcgcgtgctgccgctcgtggcggccagaggagaggagaggcagcagcatggcgagtgtcctgtcccgacgccttggaaagcggtccctcctgggagcccgggtgttgggacccagtgcctcggaggggcctcggctgccccaccctcggagccactgctagaaggggccgctccccagcctttcaccacctctgatgacaccccctgccaggagcagcccaaggaagtccttaaggctcccagcacctcgggccttcagcaggtggcctttmagcctgggcagaaggtttatgtgtggtacgggggtcaagagtgcacaggactggtggwgcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcatggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcancagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcagacccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctmtctccggtccggagccggtcgctaagcttcagcgaagccccagcagccagcacctgcgatgaaatctcatctgatcgtcacttctccaccccgggcccagagtggtgccaggaaagcccgaggggaggctaagaagtgccgcaagtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaactcga

SEQ ID NO: 211 - DNA, 938 bp, Homo sapiens
  SITE (200): n equals a,t,g, or c
ggcacaggaaaaaaaagaaaaaagaaaaaagaaaaaagtttttgtacccacagattagcattttcttgatgtttgaaaaaagtttaagctatgtcctaatttaaaaatgagcacaaactacttaacagatgtctgttccctcttctcttacttaaattatctttattttcaccatcacctcccagtgccgaacacctganctctgtgttttgtggttggatcctgggttgccaagttcctatttggtcagtccctggcctgtggggcggtctcaggaagtggcatgctcttcamgraggatcgttcatytccagtataaccawtttgttaataatagttgataattcccagcttttaccagatgarttttgacttatttttcctcctttgacctgttcaaagctaacatatctcggtcagttcggagagggtgggggatttgagaatgtgaggaggagtggggttagaatgggtttgcctatctgggcaaggaaagagttcctagtcgattgggcacaatgacaaaatgattccatggatagaatcgtcccatgttgctggaacacctcacgtgttgtgaacgccttaaattcctgccatcccttctctgattccccacctccctgtagtttccacaggatttatctctctgtacccccgtcctccaactctactctgtcagcctctcctccatcccttacttcccttctaaattccaggagatgacctcactttgcaaagcaaattggagccaccaaattgtagctctcctcggtggaaactgcatctgtgctcatccctgcaccttcttgcagaaagccgccccctcaggccaagatgagtgcctggcccccatgggagactcagacactttgaccccttgtgacttcagcatctccctctttaaagattctctcccaacattcagtcgtgctcga

SEQ ID NO: 212 - DNA, 1551 bp, Homo sapiens
  SITE (420): n equals a,t,g, or c
  SITE (1017): n equals a,t,g, or c
  SITE (1408): n equals a,t,g, or c
  SITE (1423): n equals a,t,g, or c
aggctggactaagcatagagaaccaggagagaaagaaagatttaagagactgagtaatattttttgacagatcatttaagaaactgagtaattttttttttctccaaaagggcatgggttttttttttgttttgttttttctctatttggcactttctagggattggtctataaattttttgaaagatcataggataaatttctttgtagcaacttcctattttagtgtttatgttaggggarccccargtgtccctgctgatacgccattagggccacttctcagcctctggctacatcataatgcttttttttctatcttgccaaagtttccmgaaaattkakgttttctaattttaaaaaaattggttgtggagatgggatgggacctctttataagccctgaaaataagtgatttnttttaagtgctattctgctataaacctgattctcacttttttctgtagacaacagttttttataatatatctattttgtgtggacattatttccttttaaccaatactgaaattccatagtgtawactttctccacattttctttgattaatacttycttaaaatagacacttggattggcaccagctgtcaccaataaagctgccctgaacattgtcaatcaatcctgttaaccaatttgagaatttttctggaatgcttagttagggatgaaattgctgggttataggtatgagtatgcttgatatacttttctccagaatgtctacacctgtgtgtacaccacatctccagagataggggaatcttatgtccctgctaactgctctcgttatttaattttctgacatttgccgccgccgccgccccctgcccccaacacacacatggtataaagtggtagtttcttgttttaaattgaacttttgaatgatttgaatttgggcatttctttgtatcctgagttattttggtttcccgttatgtgaatatccttttcctatgctttaactacttttctaatttgtcccttttttnggttatcaaattccaggccattgtctattccatcgtcacttttgggtattggaaacatctttccattctgtagcctgtctgttgaacataaatcttgatttttatgtaatcagatttttctccttacggttatgttcttggaattttatttaagaaatctttttctatcctgagaccacaaaaatgtccccaccattttcttctgtttcatagttttgccttgtatgtttaatcctttaaggcatgtgtagttcattttatatggtgtgaaatagttcttattcatttattcaacacatattggtggagtgcctgctgatggtagtactcttcagagtactttgtatatatttgtgaacacatattcttgccctggaagcttatgttgtcnttcaaggtagatccntactcggtttccacctgttttcttcagccctcaggatgaattccacaattttacacatagcaccagttaaggaataggctttattggagaaaaggaaggcttattagaccagcatcagcaaaaaaaaa

SEQ ID NO: 213 - DNA, 997 bp, Homo sapiens
agagagtcctcaacagaacctaatcatgctggcaccctaatctcatacttctagcctccagaactgagagaacataaactccagttgtttaagctacccagtctatggtatttgttattatagcccaagctaagtcaggtggaaaggcagaaatattttgagaagartcatttctacaaaaacagagttgttctaaatgaaatggccagatatttcatcttcttcatactagtatttatgaaagtttcattaaacaccacttggccagcacccaggcctgccaccctcagaacggcaaacaaaagcaaatgatttgaggaacaaaagagtggacacagagcctctcagaagatggctccatcttctgagatgatcttctgagatcatcaattttctgcacctgatgtcctactccaattgtagtagataagagcaaagacacttcctgatcctgtggaaaatgctggagccctgctgatggagaggctgacactgggaccaacagaaggccggacatttatttgctgcagcccttctgcacctgggccctcttcaggccttgtaccttgcactccccatgccactgtagcacctggtaagctgaagttaggtatttgaagagataatttgcccccaacaaagaattacttaaaagaaaaaggaaaccactaaattccacttgacaaaccagtttgttcagttttgacttttgcaaatttgaaactttctctttggcaccatatgattctgttacattagggctcatcaatgctaagatacacagctaggtctaccagctgccagtggtcaagaatgaaagaacctctcagagagagatcagtttctaataacctaacagttttccttggstattacmaaaaaaaaaaaaattagaataaaatgtcagtgccatgcaggcaagtacagatatggaaatgaaagctctgtctacaactgcaagatttgtttgttaataaaattgattgggatcactcga

SEQ ID NO: 214 - DNA, 1496 bp, Homo sapiens
  SITE (450): n equals a,t,g, or c
  SITE (451): n equals a,t,g, or c
  SITE (454): n equals a,t,g, or c
  SITE (1485): n equals a,t,g, or c
  SITE (1492): n equals a,t,g, or c
gaattcggcacgagtgaccacagatatctttggctttcagcctcaccacaatgctgtccactatgttttttttaatcgattgacatctcatgaatccacaaatttagccgcttttccatcttttccatctttgtcatagcttcatcacgcacgatggaggtcacttcagcactatccggagcggcctcacggacagatcrgtgaatttccttttcctttttcttgatgtaccggattgtcgactcgttaacattgagctcatggccaacagcactgtaactcatgcctgattggagcttatccaacacgcggamtttctccgtaaggsamatcamggtcttctttcgcttaggaacactgggcararcttaarcactacgcttgggggccattttagaaagcaaaaccacccacaaaaagcagaaaaaaaagtgtcagtaaacagactgnnganaggactctttgtttacagcacaggagctgcgactagaaggcggcgcttctccccagttcaaacttcagctgggaaccttacctccgccaactccaaattttcaccctctgcgcatgcccgggaaasaaacccccagaacagtaccgtgatgattgattttagggttacaaatacattttagcaagtaagtgaatttggcattacgaattaatgattaatgaaggtcacctgtatttccatagatatgtaattttatttaagcaggtttattatattaaggcggsgaggcagcgccgaagactacaagttccagcatgcaccgcgtccgggcgggttcgggctcccagcgagggcttcagggacgccagcccggaggcatcggccggaagtgtcgtagggcaaccacgtagtactctctgcgcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtgagcgattccgcctgaggcgagaagcgaattgccccgccccacgcctcacgtgaggcgcgctctgcccccgcgggcgtctgccctgtggcccaggtggtccaggggggctcctgttctcgagcgtccgctccctcaggcccctcatcctcggccgctccggcccgaggcgtgtgcgcgtggcggttctgtgctcccctcccgttgggcagctccggccgccgccccctcttgcagcgcgggaacggcacatggacacggccccttgtcgctagggacgctcgtcggtcagccccgaacgacaacgctgcttcagaagtcggggcggcagttcgagccttggaagtttttttcagccctggcccgagagagctgctggccaacaacccgtccaagatagagctgtccgntctccgnctgg

SEQ ID NO: 215 - DNA, 1308 bp, Homo sapiens
  SITE (7): n equals a,t,g, or c
  SITE (9): n equals a,t,g, or c
  SITE (1241): n equals a,t,g, or c
  SITE (1247): n equals a,t,g, or c
ttggcancngggagagggaaagaggaggaaatggggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcattatggggtatgtatgaccttcattttccaagaaatagaactctagcttagaattatggatgctctaaaatgtcagaatgggaactctcctcgaagttctcccaaactcagagacagcactgccttctcctaaatgattattcttttctccctgttttctggtattttctaggcatccttctcaccacagccataacccttttttacttccattaggccgtataactggngggacngctggtcggtatataatactggtwccaacamaggggttctggatgtacacmaggttatctt

SEQ ID NO: 216 - DNA, 1705 bp, Homo sapiens
  SITE (1281): n equals a,t,g, or c
  SITE (1704): n equals a,t,g, or c
tggccatggaagcgctagaaggtttagattttgaaacagcaaagaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcagtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagatttgcaaacaacagctcccagattcttgcggctagtgggagaccaagggactccatcggagatnaggacccgttcacagctaagctragctttgagcaaggtggctcaragttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcaaaaaaaaaaaaaaaaaaaaaaaaaaaaaaaaaaaaaaaaaaaaaaaaaaaaana

SEQ ID NO: 217 - DNA, 999 bp, Homo sapiens
agcaaatcaccttaacgatctggaatgaaactgtgaccagtgccgccctgggtggttctggagagactgccgtcttcttgtttggccataggtgctggggccccggcttcagtcactgtctcagacagkagtcccgataagcagatcaccagtcctccactgtccttcctgtcggccttgctgcatgagaagatagctgcttcctccctcttttcctacactgtaaattattgttttacaattgagtgycttaataatagtytacaaatactatgtatttatgcaaaactgttaaagttctcatctgttatgattggatacttggtcttgtcagtagtggtcagcattgggttgtgagcttgtcctactccatacgtgtttatcctgctatgcattttacattgtgtgttcacatctattccaaggagccttgctagaaacaacactggcggttcctgcaggccaggcaggcattggcccatgctgtgtcccataggagccaatggaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgatkttttttattgtttttcttcttgtttttttaaataatatatttaaaggcagtatcttttgtactgtgaatttgcagtagaagatgcagaatgcactttttttttacttctgttggtgtgtattgtatatagtgtgtgtgcttcttgtgatgaaaataaactttttctttataaaaaaaaaaaaaaaaaac

SEQ ID NO: 218 - DNA, 941 bp, Homo sapiens; identical to SEQ ID NO: 13

SEQ ID NO: 219 - DNA, 575 bp, Homo sapiens
taagtggaatcccccggggttgcagggaattcggcacgaggcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtrcgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgccccaaaaaaaaaaaaaaaaaaaaaaactcgagggggggcccgtacccaattcgccctataa

SEQ ID NO: 220 - DNA, 3018 bp, Homo sapiens
gccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttgggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctcccttttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaaagccgatatagtagctagctacttaagcatccatgggtattgctccatatcaaagcagatttgcaggacagaaagagtaaattagccttcagtcttggtttacagcttccaaggagagccttggscacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaaattaaggcctcacaggatgagtctccattctctgtaaatgcttattttatcatagtctttagcctctaactatgagtaaaatgttctcttcggccgggtgtggtgactcacacctgtaacctcagcactttgggaggcagaggtgggaggatcacttaggtccaggagttcgagactagcctgggcaacatagtgagacaccggatctacaaaaaaataaaaagccagactggtggtatgtatctgtgtcccagctaattgggagggtgagatgggaggattgtttgagcctaggagagggaggttgcagtgagccgtgatcgcaccactgcactccagcctgggcaacagagcaagaccctgtcttggagaaaccagaattttggaagagcaaatggggctgagtgcagtggctcatgcctgtaatcc

SEQ ID NO: 221 - DNA, 2031 bp, Homo sapiens
aggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctaggctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccrttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattrtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttacatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcca

SEQ ID NO: 222 - DNA, 968 bp, Homo sapiens
  SITE (241): n equals a,t,g, or c
  SITE (954): n equals a,t,g, or c
  SITE (961): n equals a,t,g, or c
ggcacgagggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactnaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtatwaaacaaagtcmcttttctccmagttgkatttgctatttttcccctatgagaagatattttgatctccccaatacattgattttggtataataaatgtgaggctgttttgcaaacttaaaaaaaaatttaaaaaaactggaggggggcccgtacccaantcgccgnatatgat

SEQ ID NO: 223 - DNA, 1404 bp, Homo sapiens
  SITE (1351): n equals a,t,g, or c
cgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggyctcagagcacttcttcgagtacaagaagagccgcagtgggaggcacgtcgtcttctacccaaccctgaagtccctgcaggtgcggctggagctggcccgggagctgggcgttggggtctctatctgggagctggccagggcctggactacttctacgacctgctctaggtgggcattgcggcctccgcggtggacgtgttcttttctaagccatggagtgagtgagcaggtgtgaaatacaggcctncactccgtttgctgtgaaaaaaaaaaaaaaaaaaaaaaaaaaaaaaaaaaaaa

SEQ ID NO: 224 - DNA, 707 bp, Homo sapiens
  SITE (1): n equals a,t,g, or c
  SITE (705): n equals a,t,g, or c
  SITE (706): n equals a,t,g, or c
  SITE (707): n equals a,t,g, or c
ngcgcgcctgcagtcgacactagtggatccaaagaattcggcacgagggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaacttttgggccgggcccctccccacaataaagatgctctccgaccttcaaaaaaaaaaaaaaaaaaactcrgggggggcccggtcccaatccccccnnn

SEQ ID NO: 225 - DNA, 1384 bp, Homo sapiens
ggggaactgcagtgacagcaggagtaagagtgggaggcaggacagagctgggacacaggtatggagagggggttcagcgagcctagagagggcagactatcagggtgccggcggtgagaatccagggagaggagcggaaacagaagaggggcagaagaccggggcacttgtgggttgcagagcccctcagccatgttgggagccaagccacactggctaccaggtcccctacacagtcccgggctgcccttggttctggtgcttctggccctgggggccgggtgggcccaggaggggtcagagcccgtcctgctggagggggagtgcctggtggtctgtgagcctggccgagctgctgcaggggggcccgggggagcagccctgggagaggcaccccctgggcgagtggcatttgctgcggtccgaagccamcaccatgagccagcaggggaaaccggcaatggcaccaktggggccatctacttcgaccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggaatctactgggtggttggaaatactcaagtttctctggcttcctcatcttccctctctgaggacccaagtytttcaagcacaagaatccagcccctgacaactttcttctgccctctcttgccccagaaacagcagaggcaggagagagactccctctggytcctatcccacytctttgcatgggamcctgtgccaaacacccaagtttaagaraararyararctgwggcaggtatacagagctggaagtggaccatggaaaacatsgataaccatgcatcytcttgcttggccacctcctgaaactgtccacctttgaagtttgaactttagtccctccamactctgactgctgcctccttcctcccagctctctcactgagttatyttcactgtacctgttccagcatatccccactatctctctttctcctgatctgtgctgtcttattctcctccttaggcttcctattacctgggattccatgattcattccttcagaccctctcctgccagtatgctaaaccctccctctctctttcttatcccgctgtcccattggcccagcctggatgaatctatcaataaaacaactagagaatggtggtcaaaaaaaaaaaaaaaaaactcga

SEQ ID NO: 226 - DNA, 774 bp, Homo sapiens
  SITE (773): n equals a,t,g, or c
tttaaagatgaagaaatgacaagggagggagatgagatggaaaggtgtttggaagagataaggggtctragaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttttctttttgcctatctgcatcttctcacttgccaaaaaatgaatatatgtttatgtgtgtatattacttgtgtcacaaaaaaccctaaagtagacagtaaaagaacttgtcaatcgcctttggaaggcaatgaaacacttaataaactctcaataacagaagcgtaaaaatgaaatgtaaacctccaattacctctggatctcttagccagagtaataaactggtaattattacagataaaaaaaaaaaaaaaaaana

SEQ ID NO: 227 - DNA, 865 bp, Homo sapiens
  SITE (344): n equals a,t,g, or c
ccacgcgtccggcctttcttggccagaggcgccggttggactcacgggcggggcatgatgggtaacaggaccggtggggtccccaggaagtcctagagggggtcggggtttgggtggacaagctttcctcgtcctctcccgacagagctgacgtgtcctgggttccaccgggagcgggcatttccaccggacgggagggttcggggtgtccggggctggggaatacgtaggggttgccgcgcggtgtggggagttggggcgtgtggctgcagtcccgggagttcttggagggggtcggcccaccgagcttccggaccggctgatctgcccgtagcttgccgganggarggcggagctgactctccgtcccttctcccatcccctccagtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtaaaaaaaaaaaaaaaaaaaaaaaaaaaaaaaaaaaaaaa

SEQ ID NO: 228 - DNA, 1102 bp, Homo sapiens
  SITE (462): n equals a,t,g, or c
  SITE (469): n equals a,t,g, or c
ttttttttttaccatttaaaataaaatgaaagtgaccttctgtttataaaaatctttgtctgcatctctgcttatttccttagaagagattccaagaagcggtgagtgatttcacggcagcagagggttgggacatattacgggcgcggatccctcttggagtgagatgactctccggagagatttagtcgtcaccctcgcgtgtgaggctgcgtcacaccccagggatgtgtctatcaagatggaagatcttttacacgctcttgattttgtttgsctytttttctattactagtgagaakgaaactttttatatgattattatccatcataatccaacacaaattactgcttcatgttcttttactttcctgtgaaggttttagtgccttttaaaaattgctatatattaagcttgttaatacttccatgctgtatttgtggscatcartttccccgggnacaggcntgcacattttgccttcacacgctgggtggtttttcattttcamttctatttctcgttcttctatcgttttatgttcagacgggtttctccgtgtagaaagcagtttatgaagatttactttcgacagtcttctctctactttctacagtgaattctctgatgtgtctgggagtttgggggtctgggtaagartcctcctctcaccctattctctattacgatccacagcctcatgctttatgarattggtggccgggarcgggggagatttgcggatcccccaagccagactttatccccctatccctgcctctggatcccacgtacaggcctgggaactccctgtgggtaggggccaatggtctcgcactctcacctgtaccccagggctggcacaggatggtcaaggagagaggctgcccaagcgcatccytctggtgtccccctgacacgcctccaaagtgagcaggtaggtttcaacagccccacgttgcaggtgggagatgaagctcagggtggagaccagtatctcacagttctctttgcatggccgggtacttgttagtcaactgatcaagtgaaaattctagccccagaggcaggagaatccggaacaaaattaaaccagccagg

SEQ ID NO: 229 - DNA, 744 bp, Homo sapiens
  SITE (303): n equals a,t,g, or c
  SITE (392): n equals a,t,g, or c
gaattcggcacgagagtggctggagtctggctgcagagggaagacatcagcagggagggagccagggcctgtcacatctttcctctggccattgtcctggtctttgtaagcccagaatctccccttccctgaagggaggccagcaccccaggagggcagcaggtgtgctgtgagggttggagtagtgtgagaggtcagggtacactagaatggccatggacaccatgtgggggtgctctgggctgggccacagaacagtgtccttcctgctgctcctcccctgcagcttcccccgaccttgtngtttatttggtttgataccaatcagcagaccctgcaaggtggaagctcccaggctctcagtcccacsactctcatgtgccagtcacccntactgtaactgcccaatgagtacttcttgcccactgccaagatagagccagtttaccaagacaggggaattgcagtagagaaagagttgaatatacatagagccagctaaatgggagagtggagttttcttattacttaaatcagcctcccytaaaattcagaggtgagaatttttcaaggacagtttggtggscaggcctagggaatggatgctgctgattggctagggatgcaatcataggggtgtagaaaagtwccttgtgcactgagtccacttttggtgagagctaccaaggagctgctggtctgctggtcccggtagagccatctggtgtcaggaatgcaaaagtg

SEQ ID NO: 230 - DNA, 1935 bp, Homo sapiens
  SITE (1): n equals a,t,g, or c
  SITE (1921): n equals a,t,g, or c
  SITE (1927): n equals a,t,g, or c
ntctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaaacaaaaagtacacagaaatatttattaaaatgtaatacagtttattgaactttctaggtatggagtttgatggacagggctgcctytaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagnttttgntttttttt

SEQ ID NO: 231 - DNA, 1035 bp, Homo sapiens
  SITE (1032): n equals a,t,g, or c
  SITE (1034): n equals a,t,g, or c
agaggcctggctgcgttgccctatctccgtctccgccacccacttagcgttttaggcatcaattaccagcagtttctccgccactatctggaaaattacccgattgctcccggcagaatacaagagcttgaagaacgccgcagttgcgtggaagcctgcagagcaagggaagcagcgtttgatgccgaatatcagcgaaatcctcacagggtggacctcgatattttaacctttacgatagctctgactgcctctgaagttatcaaccctctgatagaagaacttggttgcgataagtttatcaatagagaatagttaggtggtgacactacttcaagagaacctctgcattccagtcataccaatcctgcaacttgattttcagaagtcaagagtatatcgcgataagacagtgcacaggtggaggggaaaaaaagggggagggggaagcttatcttgaaaaagcatcacagaagtagaaaaaaatgtcgaaagcattataactgtaacgttctttgagtttgtgattgatccacatttttccccctgcattatggaaaatgtctctcagcattgctttattacaaagtaaaggatggttttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaacgtcaaatttctggacttttttctttcaatttttaatttttaaagtttttttggtattaaaaaatcyattcacaagccaaaaaatwtwtwaaatwtwcmgcgaaaagccaaaaaaaaaaaaaammagggggggccgggccccatccccccaagggggtccngnt

SEQ ID NO: 232 - DNA, 760 bp, Homo sapiens
  SITE (438): n equals a,t,g, or c
  SITE (741): n equals a,t,g, or c
gggtcgacccacgcgtccgctgaccagtccgttatagatacttcttcctataccaaaactgtttaaacaggtgccaccacaagggatgtcgtccttactctctgcgggtcttcaagcatccctttgtgggaaargtctctgggcaagcacgtggtatttggtctgctgcttgcttccctttttccaccagggatgttgtgatcataagtcaaaacaacagtatattccaaatctcaaaagctattgtggcctgagcacaattgaaatctagcagagtttttcctatgtagctttagagtaactcttctgcttctctgtcacttacaattcaggttctgcctttgcctaagagcatgagcagaagagtcctcatgtgacgcttagttctattgcagtcctgggtgaaactatttaagcwatggggctgctkctccccanwtcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataaaaaaaaaaaaaaaaaaaaaaaaaaaaaaaaaaaaaaaaaanaaaaaaaaaaaaaaaaaaa

SEQ ID NO: 233 - DNA, 2057 bp, Homo sapiens
ccgagccggctgcgccgggggaatccgtgcgggcgccttccgtcccrgtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgmtgtttatcctgcagctggacattgccttcaagctaaacaaccaaatcagrgaaaatgcagaagtctccatggacgtttccctggcttaccgtgatgacgcgtttgctgagtggactgaaatggcccatgaaagagtaccacggaaactcaaatgcaccttcacatctcccaagactccagagcatggagggccggttactatgaatgtgatgtccttcctttcatggaaattgggtctgtggcccatgaagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacaggcatcttctatgcratgcttctktccttctggatcatcttctgtggcgagcacatgatggatcagcacgagcggaaccacatcgcagggtattggaagcaagtcggacccattgccgttggtccttctgcctcttcatatttgacatgtgtgagagaggggtacaactcacgaatcccttctacagtatctggactacagacattgggaacagagctggccatggctttcatcatcgtggctggaatctgcctctgcctctaacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattgggaaatggggcggcgtcacagtcccaagtgaacagtgcctttttcacaggcatctatgggatgtggaatctgtatgtctttgctctgatgttcttgtatgcaccatcccataaaaactatggagaagaccagtccaatggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattctttgagtattgtcttacttctcttaaaaaaaaaaaaaaaaactcgtgccgaattcggcacgagcggcacga

SEQ ID NO: 234 - DNA, 2084 bp, Homo sapiens
  SITE (775): n equals a,t,g, or c
  SITE (2080): n equals a,t,g, or c
  SITE (2083): n equals a,t,g, or c
ggcagagggccatttcctgcaaagagccaaacccccattcctctgtgcccctcctctcccaccaagtgctttataaaaatagctcttgttaccggaaataactgttcatttttcactcctccctcctaggtcacacttttcagaaaaagaatctgcatcctggaaaccagaagaaaaatatgagacggggaatcatcgtgtgatgtgtgtsctgcctttggctgagtgtgtggagtcctgctcaggtgttaggtacagtgtgtttgatcgtggtggcttgaggggaaccgcttgttcagagctgtgactgcggctgcactgcagagaagctgcccttggctgctcgtagcgccgggccttctctcctcgtcatcatccagagcagccagtgtccgggaggcagaaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggccttctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggtgtnatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagcggggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagattaaaaaaaaaaaaaaaaaaaaaaaagggggggcngcnt

SEQ ID NO: 235 - DNA, 2143 bp, Homo sapiens
  SITE (2058): n equals a,t,g, or c
  SITE (2080): n equals a,t,g, or c
  SITE (2115): n equals a,t,g, or c
  SITE (2132): n equals a,t,g, or c
tcgacccacgcgtccggttgaattccttgacctgcaaacacatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggcttttattctagattgtcttattttctgttaaaaccaatgaccacatgaccacaatcttcactaactcatactgcagtgaaagtgttaacccttaggtagtttctctacaactctttgctatggtgatttttaaaaaagtttcctagggaagtatctctgagggaacaggcaatctgaaggaactgactatattctccatggctaagtccattaggccaaaagnctgggtgggtattggttgtcangctgtctattggcatattaaaaacgtaggccgganggaataattaggttgtnatgccggcggg

SEQ ID NO: 236 - DNA, 1133 bp, Homo sapiens
  SITE (528): n equals a,t,g, or c
  SITE (552): n equals a,t,g, or c
  SITE (1133): n equals a,t,g, or c
ggcacagcttggaatgaacccctgtggataagggggactattagatagaataaacatcaataaatgcttgatgaataaacgctaatcctaccttcccagcctgacacctcccagtggacaccacacttcacttgaagccttagaaacctttcccacccatgcttccagccctggcttcatgttgccatttctcacccccagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaacntgaaggagctggcccagaggcaangaggaggaggcagcccagcaggggcctgtggtggtgagccctgccagcgactacaaggacaagtacagccacctcatcggcaagggagcagccaaagacgcagcccacatgctacaggccaataagacctacggctgtktgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttcccatggggctggggtactttacattcaataaatactgtttaacccaaaaaaaaaaaaaaaaaagaaagaagn

SEQ ID NO: 237 - DNA, 1025 bp, Homo sapiens
cctggcccacattgcttcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtaccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagccaaaaaaaaaaaaaa

SEQ ID NO: 238 - DNA, 1400 bp, Homo sapiens
ggcacagtttattaatacctattatgggaaagtcactttggttggcattgaaaattacatcatctttaaagcagtatttgtccccagatggactcatcactagcaaagactaggttcattggaaggcatagggtgagagaatgggaagatgragtggaggcgggttgttaaagtgctgtcagtgagtgattttgtctacttgaataatggtccatgtttgggggcatattgtgtttcataagaagtgaaaggtatttgcaaagtaagctacaaatgacccataaatctgttaacaacagtccttaatatgcaaagatgaaaaacaagcattactgctacccaaagggaactggtgcttggtgatgtgcagatggggctgttggttaagagagctattacaggttttctctcttaggtttcataggaggtagttactgagatgagattgttttatctttttgaatacagatctcttgtcttgagttagttctgaggatgggagtaataaaggagttttttgtttttttgtttgtttgtttgttttggctccttagtaatactcctctgacatttatttctattattcttcaaagaaaggaaaccaactgaaatgtttgctttaacaaacattttaataagttctctgggtttttttttccccttttaaaaaaattagcatataccatagcaataaaagaactaatgttaactattgtatgctacaacttaagtgatttttctaaagaagcacaatgtcattgraagtattattgaaaaggatcatagtcacattgaatttgtgaaggccaaagaaattgaagggagtgatattttcattttatgatattcacatatttagtaaattttgtgtacaagaataccaggcagagtgttttacccatggaaacaggtttcagattactttgtttttactgttagagtctcaagtttagaaatgctaacacttaaatcagtttttttctcactatacttgaagattgttaatattttgatatcttcctagcttgatggaatttaaacatatcttcagatctgtgacagtgacagccaataggactgataatattagcttcaaaccaataatatccagggttaaaataaaaatcatagtgaaagtacgattgtaaaattatgctatattaacttttaagtctgtaataacttgacatcaaaatgttatgtaattaccataaataatggctagcgagaacatctttggaaattctcaaattacctttcttactacactgtttgcagaatgaatgtagaaatgatcctgttagctttctgaatgttctgtggttgaatgtgtttttgcttaaataaagcttttggtatttgtttaaatwacaaaaaaaaaaaaaaaaaaaaaaactcga

SEQ ID NO: 239 - DNA, 1250 bp, Homo sapiens
gcccacgcgtccgcccacgcgtccggcggtgcggagtatggggcgctgatggccatggagggctactggcgcttcctggcgcygctggggtcggcactgctcgtcggcttcctgtcggtgatsttcgccctcgtctgggtcctccactaccgagaggggcttggctgggatgggagcgcactagagtttaactggcacccagtgctsatggtcaccggcttcgtcttcatccagggcatcgcatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacartgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcakaatagatactcaatatgtgaatatgtgtctactagtagttaattggataaactggcagcatccctga

SEQ ID NO: 240 - DNA, 1307 bp, Homo sapiens
  SITE (651): n equals a,t,g, or c
  SITE (1064): n equals a,t,g, or c
ggcacgagagaaaagaggttgagaatgttttctagcaggcagaatgtgcatacatgttttcatgartgtcctttgggtgctgtttcttttaaatcctctgtgcacagggctctggcctttartaaactgtttttctgtcttacgtcatgctgactgggtgctaggggctgattacaaaggggaagagttgaacagacatcaggggccgatgaaaccaaaggactaggagtcaggagaacaagtcagggattaggagacagcggtttggtttattgttatccagctggaggactcctaggggcagcagcaggaggaataccagggccacggaggggcaggagtctcacagtggagggcagactctaacagatgccagctgaacgctcgctggccctggatgtcatacgagttggggaccagaaatctgggctcagagaacccgtccagggagatttgaagccatgggttatcttctagagttgatactgataatatattttaatttttattgatgtttaataccttctgaaacaggagggtaagatcagatgggaagcccytctgttgaaggatcttgggaaccttggtggttttttttttttggtttttttttttttgatcgagctgtggacatccttcttaattcgattntgaggatttgtttaactaaaaagttcccaaacacagaaagggcctccccacctgctttggggagctgtctgtsctgggagtgccaggcatccsatgggacccatcactgccagtgtctgtgcctcccagaggtcagccctgtgtctgccctggctctgtctcctctgtgacagggcagagcatttctggtcagtttctccatggtgcctcccacccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttnggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaatwctaaaaaaaaaaaaaaaaactggagggggggcccggtacccaaatcgccggatagtgatcgtaaac

SEQ ID NO: 241 - DNA, 888 bp, Homo sapiens
  SITE (830): n equals a,t,g, or c
ctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtgasmcaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggnaaaaaaaaraamaaraaaraaraaaggagatgatgatgcagaattccaccaaggctcc

SEQ ID NO: 242 - DNA, 1811 bp, Homo sapiens
  SITE (2): n equals a,t,g, or c
  SITE (4): n equals a,t,g, or c
  SITE (16): n equals a,t,g, or c
  SITE (1810): n equals a,t,g, or c
  SITE (1811): n equals a,t,g, or c
cngncagtaccggtcngattcccgggtcgacccacgcgtccgctgcattccagggcctttcagtggctttcattctgaagttcctggataacatgttccatgtcttgatggcccaggttaccastgtcattatcacaacagtgtctgtcctggtctttgacttcaggccctccctggaatttttcttggaagccscatcagtcstyctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaacctaaaaaaaaaann

SEQ ID NO: 243 - DNA, 2271 bp, Homo sapiens
  SITE (553): n equals a,t,g, or c
  SITE (2267): n equals a,t,g, or c
  SITE (2269): n equals a,t,g, or c
  SITE (2271): n equals a,t,g, or c
ctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatngacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctaaaaaaaaaaaaaaaaaaaaaaaaaaaaaaaaaaaaaaaaaaaaaaaaaaaaaaaaaaaaaaaaananan

SEQ ID NO: 244 - DNA, 2500 bp, Homo sapiens
  SITE (2459): n equals a,t,g, or c
  SITE (2473): n equals a,t,g, or c
  SITE (2475): n equals a,t,g, or c
  SITE (2478): n equals a,t,g, or c
tccaagctacgccactcgggctggggcgttgggagcgggagtgcagagcgtggtcgtggcggcggcggtgagaagagcgaggcgkaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtacgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgsacaacacagatttatacatactttgtttataaaacccgaaatatggatatgaaacgtcttatcatggttttggstggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattggaagttkggaagttcatgaggctgaagcctgtgccagaaaatcacccacagtgggatacagcaatagagggggatgaagaccaggaggacagtgagggctttgaagatagctttgagggaggaagagggagggaggaaggaaggtggtggacttaaggcagttactctggaatgggacccacagtgttttgcaccatattttggcaattttttttgcccgtttttnggaagtgttttccntnaancccaggaaccattacagaaccg

SEQ ID NO: 245 - DNA, 1338 bp, Homo sapiens
  SITE (133): n equals a,t,g, or c
  SITE (867): n equals a,t,g, or c
  SITE (1338): n equals a,t,g, or c
cttccggttctccgggcagctgccactgctgtagcttctgccacctgccacgaccgggcctctccctggcgtttggtcacctctgcttcattctccaccgcgcctatggtccctcttggagccagcgtggcgngcctggcggctcccgggtggtgagagagcggtccgggaacgatgaaggcctcgcagtgctgctgctgtctcagccacctcttggcttccgtcctcctcctgctgttgctgcctgaactaagcgggyccctggmagtcctgctgcaggcagccgaggccgcgccaggtyttgggcctcctgaccctagaccaggacattaccgccgctgccaccgggccctwacccctgcccagcagccgggccgtggtctggctgaagctgcgggggccgcggggctccgagggaggcaatggcagcaaccctgtggccgggcttgagacggacgatcacggagggaaggccggggaargctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatatttnaacaacctttaatttgctgttgcaataaataccgtatccttttattatatctttatatgtatagaagtactctgttaatgggctcagagatgttggggataaagtatactgtaataatttatctgtttgaaaattactataaaacggtgttttctgrtcggtttttgtttcctgcttaccatatgattgtaaattgttttatgtattaatcagttaatgctaattatttttgctgatgtcatatgttaaagagctataaattccaacaaccaactggtgtgtaaaaataatttaaaatytcctttactgaaaggtatttcccatttttgtggggaaaagaagccaaatttattactttgtgttggggtttttaaaatattaagaaatgtctaagttattgtttgcaaaacaataaatatgattttaaattctcttaaaaaaaaaaaaaaaaaccccgggggggggcccggn

SEQ ID NO: 246 - DNA, 654 bp, Homo sapiens
  SITE (651): n equals a,t,g, or c
gaattcggcacgaggcagcttgtgctttaaaggaggtgttcaaagcatgtctgagcagagacttttgggctctgttttaattaatactttaaaataattcatatttaaaatatcaratgtttccataaagaggaggatgtttaaatgcctccagactacattcctttttattscttgattttacctgggagtccaaagttcaattcccataaagcaagcgttttatttgtcactttcaatatacatccgattgccatgcttaagatgcaatatgggctgcggaaataggttaacccacaggctcccagggcccagtgtagaaggtgagagattcgtgtaaaatgattcaaataaaaggaagaccctggccgggtgccgtarctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgtcagtgagctgagatcgcgccacagcactccagcctgggtgacagggtgagactctgtctcaaanaga

SEQ ID NO: 247 - DNA, 1146 bp, Homo sapiens
  SITE (20): n equals a,t,g, or c
  SITE (35): n equals a,t,g, or c
  SITE (36): n equals a,t,g, or c
  SITE (37): n equals a,t,g, or c
aaaaaaaacccaggggaacnttgggggccgctttnnnttccccctccaggccattggggaattcttcaagttaatcctgctttgctcttggccaacagggcttgtaggggggagagacccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgyctcatttccggctggggcagmacgtccagcccccagttacgcctgcctcacaccttgsgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgaaaaaraaaaaaaaaaaaaactcga

SEQ ID NO: 248 - DNA, 1443 bp, Homo sapiens
  SITE (776): n equals a,t,g, or c
  SITE (907): n equals a,t,g, or c
  SITE (1288): n equals a,t,g, or c
ataaactgaaataggtcatgcaaatataaaatattatttttaaattatttgtcataagaaacgatggtggccatattttgctttaataatggaaaaaatgtggttagcattctktggaaggtggtcatcagatagtagacattttctaggatttatttctacctgcatatgtggaaatgtgtactactttagatttatwtaatggcagctaactcagaggcatcaaaatgtgctaatggtgtaatatggcctttgtcttgctgtyctgttttgtargccttcaatcaagcargggcagggccgtacagtgaacttgtcctttgscagacgccagcgtctgcccctgaccccgtctccactctctgtgtcctggaggaggagccccttgatgcytaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggtgagtgcaagggagtagaaatctgcatcagcacatcagcacttggggatctaagtaaacctctcggggaaaatgaccaagtggatgtcatctcccagctgtttctaagagcccagatgtccagagtattgtctcaccttgatccctcaggccagaagacctgtgaaaaagccacactggttcagggactcactggacggttttgtgtccactytaacntgcaccgtctctaccccagagtggactcaratcctcaagtcatcctctgaacattgrrgtcagaaattataaaagggctttggcaatatgttagcccaagaatttggcttcttccagaaattgtgccgacnttaacagtggcttaaatgatggtaaaacttttaagatttctaaaaggrtggcattggagatacgttgacttttattaaacmacctatagttgtttaatgayttctaaaaaaatatctggagctcaggggttcaactgagggaacacatgttgagratcattgtttactaattaaatgccaggtaacccgttgaaattatcaaaaacatcttccacgtaccagaaagcacctcagaggatagttctgttatggagaagatgaaatggtttagtagtgtaggaactatggaaaggtgagcttagatttggatagtaaaacctcaagaccctatttaaaaagtattttatgaatgcagcataaataatttaattcagtgttaanatgccaaggctagtatattgagctgaatgtgaaaagaaactcacattgggagaatgccaccttttccttataagatagctttgaagataccattttagacagatggaaattgaatagctttagaaaaggcaaatgtttgatcttggggaaaaaaa

SEQ ID NO: 249 - protein, 31 aa, Homo sapiens
  SITE (31): Xaa equals stop translation
MLSTGIEVARPPATLLGLMFVLTGMPRGLRX

SEQ ID NO: 250 - protein, 116 aa, Homo sapiens
  SITE (36): Xaa equals any of the naturally occurring L-amino acids
  SITE (78): Xaa equals any of the naturally occurring L-amino acids
  SITE (116): Xaa equals stop translation
MNVVIVIILFSFDSVGTMFSCNRIPKITVLNKLKFXCEVLLRIQTIQGFYRCTRISRYKGIFPDFCQSQCMGCNPESXMAVPALVTPILAHRKKEKGMCLFTLIIAPTRCTHYFCX

SEQ ID NO: 251 - protein, 103 aa, Homo sapiens
  SITE (103): Xaa equals stop translation
MSSAKIVRQRGAVPTYYTTEAGEIIFLVLNWSLSILHIVDVLCSKPEKSVTEDAASGLSQRMTALVWRKGPDGGSRKPILLLFFFLPLILCFHSFIHSSNICX

SEQ ID NO: 252 - protein, 42 aa, Homo sapiens
  SITE (7): Xaa equals any of the naturally occurring L-amino acids
  SITE (13): Xaa equals any of the naturally occurring L-amino acids
  SITE (22): Xaa equals any of the naturally occurring L-amino acids
MILFPQXALRLGXWPRTWSILXKYSVNFFSAYSPMGAVGTEF

SEQ ID NO: 253 - protein, 37 aa, Homo sapiens
  SITE (32): Xaa equals any of the naturally occurring L-amino acids
  SITE (37): Xaa equals stop translation
MIILLLFMLLNNVVLVQEDNCQRKNTVQERRXWSQWX

SEQ ID NO: 254 - protein, 128 aa, Homo sapiens
  SITE (4): Xaa equals any of the naturally occurring L-amino acids
  SITE (12): Xaa equals any of the naturally occurring L-amino acids
  SITE (128): Xaa equals stop translation
MAAXPPGCTPPXLLDISWLTESLGAGQPVPVECRHRLEVAGPRKGPLSPAWMPAYACQRPTPLTHHNTGLSELLEHGVCEEVERVRRSERYQTMKVRRAGLGPTPGMSCPGNDNTVHTMHGEANRGSX

SEQ ID NO: 255 - protein, 67 aa, Homo sapiens
  SITE (8): Xaa equals any of the naturally occurring L-amino acids
  SITE (67): Xaa equals stop translation
MSILCCPXLCLFFSFCISSGSCPFSHVSQLSFIATFSQSSPVLLVPAYNTYLSFLAFLDCASLTSTX

SEQ ID NO: 256 - protein, 69 aa, Homo sapiens
  SITE (69): Xaa equals stop translation
MSTFQLLLLILAQSTYKIKSKPLHMTNHTLLNSPGLNPSSPTLNFKTQQHESVSYACCHMRSLHHAFAX

SEQ ID NO: 257 - protein, 44 aa, Homo sapiens
  SITE (36): Xaa equals any of the naturally occurring L-amino acids
  SITE (37): Xaa equals any of the naturally occurring L-amino acids
  SITE (44): Xaa equals stop translation
MVSVVLIFSFLSLTISTTASAYNGNDTQGWNDKFHXXSVKTQTX

SEQ ID NO: 258 - protein, 51 aa, Homo sapiens
  SITE (51): Xaa equals stop translation
MISDAGAGFGVFLLVPRAGHCWGAGKPLPSCPSVASIPSWVLPSFLERGRX

SEQ ID NO: 259 - protein, 43 aa, Homo sapiens
  SITE (43): Xaa equals stop translation
MVQTIQDFLSLFSTPIFLLLLMFETLSLAPAWLKPLRVTSHSX

SEQ ID NO: 260 - protein, 61 aa, Homo sapiens
  SITE (61): Xaa equals stop translation
MILMPGLGTSRQRSVPFVPTLNASTPGAMTGPTATLTSCQWTTACRVSWANGWTSLRTFRX

SEQ ID NO: 261 - protein, 36 aa, Homo sapiens
  SITE (36): Xaa equals stop translation
MSHHAQPRFLLITMLLQEAKPVSNIPHLLESWYFGX

SEQ ID NO: 262 - protein, 38 aa, Homo sapiens
  SITE (38): Xaa equals stop translation
MNSLFWMILLPVSQDQVVEGLQGGFSQIHMRILRKHLX

SEQ ID NO: 263 - protein, 211 aa, Homo sapiens
  SITE (5): Xaa equals any of the naturally occurring L-amino acids
  SITE (211): Xaa equals stop translation
MSRSXDVTNTTFLLMAASIYLHDQNPDAALRALHQGDSLECTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSAEAGPELSGPX

SEQ ID NO: 264 - protein, 548 aa, Homo sapiens
  SITE (548): Xaa equals stop translation
MEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPVKGKRRGRGPKGDKASDPEAGVARGIDFHHVSAVLNFDLPPTPEAYIHRAGRTARANNPGIVLTFVLPTEQFHLGKIEELLSGENRGPILLPYQFRMEEIEGFRYRCRDAMRSVTKQAIREARLKEIKEELLHSEKLKTYFEDNPRDLQLLRHDLPLHPAVVKPHLGHVPDYLVPPALRGLVRPHKKRKKLSSSCRKAKRAKSQNPLRSFKHKGKKFRPTAKPSX

SEQ ID NO: 265 - protein, 299 aa, Homo sapiens
MTTVPPSPRPMSRPSERNMRRPRGPSPLPASPRNSTPDEPDVHFSKKFLNVFMSGRSRSSSAESFGLFSCIINGEEQEQTHRAIFRFVPRHEDELELEVDDPLLVELQAEDYWYEAYNMRTGARGVFPAYYAIEVTKEPEHMAALAKNSDWVDQFRVKFLGSVQVPYHKGNDVLCAAMQKIATTRRLTVHFNPPSSCVLEISVRGVKIGVKADDSQEAKGNKCSHFFQLKNISFCGYHPKNNKYFGFITKHPADHRFACHVFVSEDSTKALAESVGRAFQQFYKQFVEYTCPTEDIYLE

SEQ ID NO: 266 - protein, 40 aa, Homo sapiens
  SITE (8): Xaa equals any of the naturally occurring L-amino acids
  SITE (40): Xaa equals stop translation
LLYLLKVXVIFVFSSSKGVTLVSMNLTSFFVSSVLACFSX

SEQ ID NO: 267 - protein, 594 aa, Homo sapiens
  SITE (99): Xaa equals any of the naturally occurring L-amino acids
MPASSLESRSFLLAKKSGENVAKFIINSYPKYFQKDIAEPHIPCLMPEYFEPQIKDISEAALKERIELRKVKASVDMFDQLLQAGTTVSLETTNSLLDXLCYYGDQEPSTDYHFQQTGQSEALEEENDETSRRKAGHQFGVTWRAKNNAERIFSLMPEKNEHSYCTMIRGMVKHRAYEQALNLYTELLNNRLHADVYTFNALIEATVCAINEKFEEKWSKILELLRHMVAQKVKPNLQTFNTILKCLRRFHVFARSPALQVLREMKAIGIEPSLATYHHIIRLFDQPGDPLKRSSFIIYDIMNELMGKRFSPKDPDDDKFFQSAMSICSSLRDLELAYQVHGLLKTGDNWKFIGPDQHRNFYYSKFFDLICLMEQIDVTLKWYEDLIPSAYFPHSQTMIHLLQALDVANRLEVIPKIWKDSKEYGHTFRSDLREEILMLMARDKHPPELQVAFADCAADIKSAYESQPIRQTAQDWPATSLNCIAILFLRAGRTQEAWKMLGLFRKHNKIPRSELLNELMDSAKVSNSPSQAIEVVELASAFSLPICEGLTQRVMSDFAINQEQKEALSNLTALTSDSDTDSSSDSDSDTSEGK

SEQ ID NO: 268 - protein, 131 aa, Homo sapiens
  SITE (131): Xaa equals stop translation
MKLNLCIPNWARCPLLLLFPQLLPFQGEDDDPLKAKAANLVEAVPWGIKAPSFQVTCLVRVQLQSCTPSRPSTLLATSQSPGRISCYSPLSHLPPVTTSIQPSPVMVPFQYQAFLLQVKEPAAQTLLGQQX

SEQ ID NO: 269 - protein, 21 aa, Homo sapiens
  SITE (14): Xaa equals any of the naturally occurring L-amino acids
  SITE (19): Xaa equals any of the naturally occurring L-amino acids
  SITE (21): Xaa equals stop translation
MRYHAQLIFCIFCXFVFVXKX

SEQ ID NO: 270 - protein, 159 aa, Homo sapiens
  SITE (109): Xaa equals any of the naturally occurring L-amino acids
  SITE (118): Xaa equals any of the naturally occurring L-amino acids
  SITE (122): Xaa equals any of the naturally occurring L-amino acids
  SITE (127): Xaa equals any of the naturally occurring L-amino acids
MTGTYSGQFVMEGFLNLKWSRFARVVLTRSIAIIPTLLVAVFQDVEHLTGMNDFLNVLQSLQLPFALIPILTFTSLRPVMSDFANGLGWRIAGGIWSYHLFHHMYFVVXYVRDLRHVXLYVXAAVVXRGLSGLCVLLGLAMFDCTGHVLPGLWAYGKHL

SEQ ID NO: 271 - protein, 219 aa, Homo sapiens
  SITE (219): Xaa equals stop translation
MHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDELX

SEQ ID NO: 272 - protein, 50 aa, Homo sapiens
  SITE (41): Xaa equals any of the naturally occurring L-amino acids
  SITE (48): Xaa equals any of the naturally occurring L-amino acids
  SITE (50): Xaa equals stop translation
MWVIRVFQKTFLFFVLFWSVHCISDKFGCLWHVCMKREGDXNCLSFSXLX

SEQ ID NO: 273 - protein, 122 aa, Homo sapiens
  SITE (7): Xaa equals any of the naturally occurring L-amino acids
  SITE (20): Xaa equals any of the naturally occurring L-amino acids
  SITE (122): Xaa equals stop translation
MPSQTEXFAACGGHSLLLVXLPLGLPFCPRAALCDLPFSLPSFPGQARRGGAEKQGAEGRGLQVKPRGQRTFQVSRTAPAAPRSRQPRPPAALPALGFGGRGVAKGRFLCFWCLYMLRIDQX

SEQ ID NO: 274 - protein, 88 aa, Homo sapiens
  SITE (53): Xaa equals any of the naturally occurring L-amino acids
  SITE (88): Xaa equals stop translation
MTAFCSLLLQAQSLLPRTMAAPQDSLRPGEEDEGMQLLQTKDSMAKGARPGAXRGRARWGLAYTLLHNPTLQVFRKTALLGANGAQPX

SEQ ID NO: 275 - protein, 26 aa, Homo sapiens
  SITE (26): Xaa equals stop translation
MIQVSVPLLTIMIFLLYLQIGPGKLX

SEQ ID NO: 276 - protein, 29 aa, Homo sapiens
  SITE (29): Xaa equals stop translation
MLLDPFILLFCLFSTAAQSCLEFIYIQFX

SEQ ID NO: 277 - protein, 44 aa, Homo sapiens
  SITE (14): Xaa equals any of the naturally occurring L-amino acids
  SITE (44): Xaa equals stop translation
MKFLSILLDDNNFXLMLMLAPFGCLAFERSMKMRNGALGLEEVX

SEQ ID NO: 278 - protein, 363 aa, Homo sapiens
  SITE (307): Xaa equals any of the naturally occurring L-amino acids
  SITE (363): Xaa equals stop translation
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQXSEHFFEYKKSRSGRHVVFYPTLKSLQVRLELARELGVGVSIWELGQGLDYFYDLLX

SEQ ID NO: 279 - protein, 128 aa, Homo sapiens
  SITE (128): Xaa equals stop translation
LPTKILVKPDRTFEIKIGQPTVSYFLKAAAGIEKGARQTGKEVAGLVTLKHVYEIARIKAQDEAFALQDVPLSSVVRSIIGSARSLGIRVVKDLSSEELAAFQKERAIFLAAQKEADLAAQEEAAKKX

SEQ ID NO: 280 - protein, 54 aa, Homo sapiens
  SITE (54): Xaa equals stop translation
MLLQIHPLLPSPTIPHILLLFLYPTFSILEHSCSYCIEYLWVCLLFCLSLWFLX

SEQ ID NO: 281 - protein, 29 aa, Homo sapiens
MCLWCCGDVCSGLSSLLSLCVCCVVLAVC

SEQ ID NO: 282 - protein, 26 aa, Homo sapiens
  SITE (26): Xaa equals stop translation
EGLRLLLSLPAALPRSCCHPRWLPVX

SEQ ID NO: 283 - protein, 221 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWLQTLSGMSASDELDDSQVRQMLFDLESAYNAFNRFLHA

SEQ ID NO: 284 - protein, 40 aa, Homo sapiens [sequence omitted]

SEQ ID NO: 285 - protein, 49 aa, Homo sapiens
  SITE (6): Xaa equals any of the naturally occurring L-amino acids
  SITE (38): Xaa equals any of the naturally occurring L-amino acids
  SITE (49): Xaa equals stop translation
MQAPFXHFSFRMFSNLYCFSDFQPNISPCPLCHCILPXHHHVFLLLAVX

SEQ ID NO: 286 - protein, 52 aa, Homo sapiens
  SITE (52): Xaa equals stop translation
MKLVTMFDKLSRNRVIQPMGMSPRGHLTSLQDAMCETMEQQLSSDPDSDPDX

SEQ ID NO: 287 - protein, 32 aa, Homo sapiens
  SITE (32): Xaa equals stop translation
MAVGEAVFVPLQHPPLLHGSPIPKLLPGPLLX

SEQ ID NO: 288 - protein, 57 aa, Homo sapiens
  SITE (52): Xaa equals any of the naturally occurring L-amino acids
  SITE (57): Xaa equals stop translation
MNGCHRRKRLHLCKTIYLLWFVFSFLLSNEVVSSHWHILRAVQIICTLFHRXISAFX

SEQ ID NO: 289 - protein, 22 aa, Homo sapiens
  SITE (22): Xaa equals stop translation
MGWVSSPHVKRRECVLKKPFFX

SEQ ID NO: 290 - protein, 51 aa, Homo sapiens
  SITE (51): Xaa equals stop translation
MFNFFKNPLLTCLFISCYLYLSLLVNKVLFAEEGLCCTYCTTSNTGEGGVX

SEQ ID NO: 291 - protein, 98 aa, Homo sapiens
MVYIYHIFFIHSLLDGQLGWFHIFAIVSCAAPDIIFNSFAFSTYISKSCSFYLQNVSCIHSSLSIFNLFQCPIISCMEECNNWLTGLFLHFKIKRCDR

SEQ ID NO: 292 - protein, 66 aa, Homo sapiens
  SITE (44): Xaa equals any of the naturally occurring L-amino acids
  SITE (66): Xaa equals stop translation
MLCTILTVVIIIAAQTTRTTGIPKNAPGPAPLCAPRSPRLFLQXYRGPNGRPAHPFLGPSDLDTSX

SEQ ID NO: 293 - protein, 257 aa, Homo sapiens
  SITE (75): Xaa equals any of the naturally occurring L-amino acids
  SITE (187): Xaa equals any of the naturally occurring L-amino acids
  SITE (229): Xaa equals any of the naturally occurring L-amino acids
  SITE (232): Xaa equals any of the naturally occurring L-amino acids
  SITE (235): Xaa equals any of the naturally occurring L-amino acids
  SITE (236): Xaa equals any of the naturally occurring L-amino acids
  SITE (237): Xaa equals any of the naturally occurring L-amino acids
  SITE (257): Xaa equals stop translation
MLGAKPHWLPGPLHSPGLPLVLVLLALGAGWAQEGSEPVLLEGECLVVCEPGRAAAGGPGGAALGEAPPGRVAFXAVRSHHHEPAGETGNGTSGAIYFDQVLVNEGGGFDRASGSFVAPVRGVYSFRFHVVKVYNRQTVQVSLMLNTWPVISAFANDPDVTREAATSSVLLPLDPGDRVSLRLRRGXSTGWLEILKFLWLPHLPSLKDPSLSSTRIQPLTTFFCPLLPXKQXKQXXXSLWLLSHLFAWEPVPNTQVX

SEQ ID NO: 294 - protein, 103 aa, Homo sapiens
  SITE (78): Xaa equals any of the naturally occurring L-amino acids
  SITE (80): Xaa equals any of the naturally occurring L-amino acids
  SITE (81): Xaa equals any of the naturally occurring L-amino acids
  SITE (82): Xaa equals any of the naturally occurring L-amino acids
  SITE (103): Xaa equals stop translation
MAPRALPGSAVLAAAVFVGGAVSSPLVAPDNGSSRTLHSRTETTPSPSNDTGNGHPEYIAYALVPVFFIMGLFGVLIXPXXXKKKGYRCTTEAEQDIEEEKGX

SEQ ID NO: 295 - protein, 33 aa, Homo sapiens
  SITE (33): Xaa equals stop translation
MPVTLSSLGFWVLLSLLFPWRTDQGCGPATCYX

SEQ ID NO: 296 - protein, 43 aa, Homo sapiens
  SITE (10): Xaa equals any of the naturally occurring L-amino acids
  SITE (43): Xaa equals stop translation
MVLGLLLLLXFFSFSSSPSPSSSLLLLSSFFFQSLALSPRLEX

SEQ ID NO: 297 - protein, 21 aa, Homo sapiens
  SITE (21): Xaa equals stop translation
EWLVFTFLLVFGSPLGKGPLX

SEQ ID NO: 298 - protein, 70 aa, Homo sapiens
  SITE (70): Xaa equals stop translation
MIRALSLFLLIFDAALFSLSVFVFIGHLLPMPKGTGLHSCAKHLIKSLKENVLPLMNYPDCKLKINISPX

SEQ ID NO: 299 - protein, 75 aa, Homo sapiens
  SITE (75): Xaa equals stop translation
MGKLIRLSVMVMSVRRLFSIYWVLSTVPDAVGSRGGMEEECSRGLCCVAGQHKQAKGKRQAWNKGGEYQCVTYCX

SEQ ID NO: 300 - protein, 33 aa, Homo sapiens
  SITE (33): Xaa equals stop translation
MPALVTLLLLFPLLPLMEASCHVMRCPMERPTX

SEQ ID NO: 301 - protein, 17 aa, Homo sapiens
  SITE (17): Xaa equals stop translation
EAPWGLLKLLLLLAVFX

SEQ ID NO: 302 - protein, 17 aa, Homo sapiens
  SITE (17): Xaa equals stop translation
MQQKQKKANEKKEEPKX

SEQ ID NO: 303 - protein, 111 aa, Homo sapiens
  SITE (9): Xaa equals any of the naturally occurring L-amino acids
MQSPKFLSXTPYLFQTPFHLISLPCHFFIFKMPIVYVLFKFFERLKQPLSKIPFCLLAFKFSIRAFFLPLWHAALWLSFVFFAGFLHDVVVVSCLTLCGVVSCSFSSPRCL

SEQ ID NO: 304 - protein, 12 aa, Homo sapiens
  SITE (12): Xaa equals stop translation
MALLISSLIWSX

SEQ ID NO: 305 - protein, 35 aa, Homo sapiens
  SITE (35): Xaa equals stop translation
MQMFTVSLLLSLLLRSTDQNHLQLLVGREDHYGGX

SEQ ID NO: 306 - protein, 15 aa, Homo sapiens
  SITE (15): Xaa equals stop translation
MSESACILNNQKELX

SEQ ID NO: 307 - protein, 44 aa, Homo sapiens
  SITE (44): Xaa equals stop translation
MDLDRVKAEATEDITSGVLCLLFLRLPPNSCIFPSAVLGSTRTX

SEQ ID NO: 308 - protein, 137 aa, Homo sapiens
MMVVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRN

SEQ ID NO: 309 - protein, 34 aa, Homo sapiens
  SITE (34): Xaa equals stop translation
MFIFLFLCVLSRKIQEEYYRLFKNVPCCFGCLRX

SEQ ID NO: 310 - protein, 137 aa, Homo sapiens
  SITE (137): Xaa equals stop translation
MRTPGPLPVLLLLLAGAPAARPTPPTCYSRMRALSQEITRDFNLLQVSEPSEPCVRYLPRLYLDIHNYCVLDKLRDFVASPPCWKVAQVDSLKDKARKLYTIMNSFCRRDLVFLLDDCNALEYPIPVTTVLPDRQRX

SEQ ID NO: 311 - protein, 58 aa, Homo sapiens
  SITE (14): Xaa equals any of the naturally occurring L-amino acids
  SITE (37): Xaa equals any of the naturally occurring L-amino acids
  SITE (58): Xaa equals stop translation
MWLLKPSAHSPVHXLVLLFPRGWSQPGTHKRQILVNXASLPGGCLLPWIWSGAALRFX

SEQ ID NO: 312 - protein, 35 aa, Homo sapiens
  SITE (35): Xaa equals stop translation
MSRRAEASIFVLPKTLLFVLFPAFPSPAVGCPVPX

SEQ ID NO: 313 - protein, 90 aa, Homo sapiens
  SITE (90): Xaa equals any of the naturally occurring L-amino acids
MALEMVWGSVYHCSCYITPWSKIQSFSLSLFQFILQEVNITLPENSVWYERYKFDIPVFHLNGQFLMMHRVNTSKLEKQLLKLEQQSTGX

SEQ ID NO: 314 - protein, 95 aa, Homo sapiens
  SITE (95): Xaa equals stop translation
MFVLFSLPKYAGLRLPIPGLSALLVFLLSLFSRRAQVELTTGRETLPKNLQGYFPEFGFQVQNFLSCKIYAASQKQPLPPLYQLRFYLKHMGLPX

SEQ ID NO: 315 - protein, 44 aa, Homo sapiens
  SITE (44): Xaa equals stop translation
MSSHWTLKILLVPLFYLSLEFPSGFVLCLANDLGYHFSSRVRSX

SEQ ID NO: 316 - protein, 31 aa, Homo sapiens
  SITE (31): Xaa equals stop translation
MLVVNINLVFLLFFIFLCYLDACINVFCFYX

SEQ ID NO: 317 - protein, 113 aa, Homo sapiens
  SITE (69): Xaa equals any of the naturally occurring L-amino acids
  SITE (113): Xaa equals stop translation
MPVLPGRTTALLSLTLAFAVPCSGVEAGPCVPRSHGCSSWEASVCVTSSTPGGSWRARALFPSAAWHRXAAWDSPWTQTGDFARGAMGGAGALPGGCVCISGRPRAQKLPALX

SEQ ID NO: 318 - protein, 235 aa, Homo sapiens
MSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 319 - protein, 35 aa, Homo sapiens
  SITE (35): Xaa equals stop translation
MENFFFSFYLFLITLIPNGRTLSTTADHCKIPCIX

SEQ ID NO: 320 - protein, 35 aa, Homo sapiens
  SITE (35): Xaa equals stop translation
MELWELALCLLVALSAHMFTVQLLADLGFLFGGFX

SEQ ID NO: 321 - protein, 82 aa, Homo sapiens
  SITE (82): Xaa equals stop translation
MGAGILALLLPLESVLTCSWISVSTSERQLWQSSQKATILSLKLDSCFCGHSGLKGKNEDTDSSVPIIPSKTHTHLGKHLIX

SEQ ID NO: 322 - protein, 72 aa, Homo sapiens
  SITE (47): Xaa equals any of the naturally occurring L-amino acids
  SITE (70): Xaa equals any of the naturally occurring L-amino acids
  SITE (72): Xaa equals stop translation
MFYFVLFIYSSSETWSGSVAQDGVHGVIIGHCSVELPGSGDPPASAXLVAGTIGTCPTMPGFVYFLNDVXNX

SEQ ID NO: 323 - protein, 34 aa, Homo sapiens
  SITE (10): Xaa equals any of the naturally occurring L-amino acids
  SITE (34): Xaa equals stop translation
MDSTLRQGRXLLTLVPASLFSLTLGGPGPWKDPX

SEQ ID NO: 324 - protein, 115 aa, Homo sapiens
  SITE (111): Xaa equals any of the naturally occurring L-amino acids
  SITE (112): Xaa equals any of the naturally occurring L-amino acids
  SITE (115): Xaa equals any of the naturally occurring L-amino acids
MQVVGSWPGRVGVVGLAFSLVIPPPAICIAGPAPGLGGGERQQKGLGRGGGGLRNCPGRVGMAAEPGALLCLTSRDGSLLLSCVRPHHVIKPKGTAKKKKKKKKKKKKKKXXGGX

SEQ ID NO: 325 - protein, 108 aa, Homo sapiens
  SITE (98): Xaa equals any of the naturally occurring L-amino acids
  SITE (99): Xaa equals any of the naturally occurring L-amino acids
  SITE (100): Xaa equals any of the naturally occurring L-amino acids
MDLPQFIYLFIFCFCCLAIVNNASINIHIQVSMWLYVFISLGYLHGSRILGHNIILCLTSQRIAKRFFIVAASFTFPPAMYKDFYFSISLHLPTLLFXXXFVFSLLPP

SEQ ID NO: 326 - protein, 65 aa, Homo sapiens
  SITE (36): Xaa equals any of the naturally occurring L-amino acids
  SITE (65): Xaa equals stop translation
MCSPSLSSSPPPLLQVFFFFFFSPHWAAKVVPQWKXRHPQVSSQLLLCFLRVNCQFLFLQEILFX

SEQ ID NO: 327 - protein, 49 aa, Homo sapiens
MCLSRWKIFYTLLILFAFFSITSENETFYMIIIHHNPTQITASCSFTFL

SEQ ID NO: 328 - protein, 293 aa, Homo sapiens
  SITE (36): Xaa equals any of the naturally occurring L-amino acids
MERPDWETAIQKPLCSLPAGSGNALAASLNHYAGYXQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 329 - protein, 68 aa, Homo sapiens
  SITE (68): Xaa equals stop translation
MPLEGFCLVLDIGFLLVMLISLASECFTTCLDSFSTTEPGCKFYKLLHSVSLLNINFNVKSLLCSHIX

SEQ ID NO: 330 - protein, 105 aa, Homo sapiens
  SITE (105): Xaa equals stop translation
MPLQLSGQYWISLLVFLSLQPFPQAAIPCALTDVGGSCVICHILLNCLCILFTLTAPSLSHVLLIKMSLSVCYEPGADLSDRAATGNKKLTRSTCLLMHSNKLCX

SEQ ID NO: 331 - protein, 58 aa, Homo sapiens
MWGCSGLGHRTVSFLLLLPCSFPRPCGLFGLIPISRPCKVEAPRPLSPTTLMCQSPLL

SEQ ID NO: 332 - protein, 39 aa, Homo sapiens
  SITE (14): Xaa equals any of the naturally occurring L-amino acids
  SITE (39): Xaa equals stop translation
MLNVLSKVQQLVSXLGLVTFLLNHSAAGGSPQHRWLLLX

SEQ ID NO: 333 - protein, 72 aa, Homo sapiens
  SITE (58): Xaa equals any of the naturally occurring L-amino acids
  SITE (72): Xaa equals stop translation
MKAIARACLLLSLLVLPHVVSEHLFWHHNPRHPVIWPFPPFHLISCSVSASTWHLGEXLLLLVPIAPSVWSX

SEQ ID NO: 334 - protein, 62 aa, Homo sapiens
  SITE (62): Xaa equals stop translation
MEQGGGPRLLLLIPGLLHNTYLARPGDFPAQGTTENTECQGSPSPISHLGKVRSLDSNTQIX

SEQ ID NO: 335 - protein, 286 aa, Homo sapiens
  SITE (286): Xaa equals stop translation
MPLLFFSVSTLFSGSVTLQQRGMFLPWTGTGEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNFX

SEQ ID NO: 336 - protein, 55 aa, Homo sapiens
  SITE (55): Xaa equals stop translation
MFRALRDLLTHYPQQILLQVLVVMYQVLQVWELPWPELIHLQGIVPTDQLHLKQX

SEQ ID NO: 337 - protein, 59 aa, Homo sapiens
MSYPLFLFMSCMVISLSPNAGSQTSTVRCLSDLVTFTLIKGSPVHQTPYLESSINCITF

SEQ ID NO: 338 - protein, 120 aa, Homo sapiens
  SITE (120): Xaa equals stop translation
MHPARKLLSLLFLILMGTELTQDSAAPDSLLRSSKGSTRGSLAAIVIWRGKSESRIAKTPGIFRGGGTLVLPPTHTPEWLILPLGITLPLGAPETGGGDCAAETWKGSQRAGQLCALLAX

SEQ ID NO: 339 - protein, 38 aa, Homo sapiens
  SITE (33): Xaa equals any of the naturally occurring L-amino acids
MPSFFLSLIQTNTLGSASFLLFLTLHIHLSPNXVHSAS

SEQ ID NO: 340 - protein, 46 aa, Homo sapiens
MFSRTSNFWTFFFQFLIFKVFLVLKNLFTSQKIYKIYSEKPKKKKK

SEQ ID NO: 341 - protein, 18 aa, Homo sapiens
  SITE (18): Xaa equals stop translation
MGLLIFMLLIGIHSQCSX

SEQ ID NO: 342 - protein, 87 aa, Homo sapiens
  SITE (87): Xaa equals stop translation
MVLFCFVLFCFVFEMDSSSVTQAGVQWCDLGSLQAPPPGFSPFSCLSLPSSWDYRRPPPRPANFLYFLVETGFHHVSQDGLDLLTSX

SEQ ID NO: 343 - protein, 538 aa, Homo sapiens
  SITE (538): Xaa equals stop translation
MSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGMQLPCKSREDCALFVSELYQELFSASKYSFINDNAASGIX

SEQ ID NO: 344 - protein, 202 aa, Homo sapiens
  SITE (202): Xaa equals stop translation
MGIALAVLGWLAVMLCCALPMWRVTAFIGSNIVTSQTIWEGLWMNCVVQSTGQMQCKVYDSLLALPQDLQAARALVIISIIVAALGVLLSVVGGKCTNCLEDESAKAKTMIVAGVVFLLAGLMVIVPVSWTAHNIIQDFYNPLVASGQKREMGASLYVGWAASGLLLLGGGLLCCNCPPRTDKPYSAKYSAARSAAASNYVX

SEQ ID NO: 345 - protein, 122 aa, Homo sapiens
MVSISVVLRVSLPTLEPVPVAGRSIWISTTSPSMISVSSLMRTPMDRRKACVSASVLLISREKISLPAMAVNGVSGPRACAMPMAMAVFPVPGWPAIRTARPAIFPSRIISSTTPAARRAAS

SEQ ID NO: 346 - protein, 260 aa, Homo sapiens
MLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTGDRAGIKDRVYSNSIYELLENGQRAGTCVLEYATPLQTLFAMSQYSQAGFSGEDRLEQAKLFCRTLEDILADAPESQNNCRLIAYQEPADDSSFSLSQEVLRHLRQEEKEEVTVGSLKTSAVPSTSTMSQEPELLISGMEKPLPLRTDFS

SEQ ID NO: 347 - protein, 48 aa, Homo sapiens
  SITE (48): Xaa equals stop translation
MTPQKPALAVLLLEVPLLLTLSVLKKRCLVTCEPTSRFVSCDLPLSVX

SEQ ID NO: 348 - protein, 334 aa, Homo sapiens
  SITE (288): Xaa equals any of the naturally occurring L-amino acids
  SITE (334): Xaa equals stop translation
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGXSVQGALILAELLSAVKRSLARTLVIIVSLGYGIVKPRLESLFIRLX

SEQ ID NO: 349 - protein, 200 aa, Homo sapiens
  SITE (4): Xaa equals any of the naturally occurring L-amino acids
  SITE (193): Xaa equals any of the naturally occurring L-amino acids
  SITE (200): Xaa equals stop translation
MVLXVVTLGLALFTLCGKFKRWKLNGAFLLITAFLSVLIWVAWMTMYLFGNVKLQQGDAWNDPTLAITLAASAGSSSSSTPSLRSTAPFCQPCRRTRPTTSTRRSPGCGRRPSRRTCSCRGPIWRTRPSPWMNTMQLSEQQDFPTAAWEKDPVAAWGKDPALRLEATCISQLRWPSCSTVGPSQLLRQVTQEXTFGERLX

SEQ ID NO: 350 - protein, 24 aa, Homo sapiens
  SITE (24): Xaa equals stop translation
MLLHHQLLIVTLHLVLLLATLLVX

SEQ ID NO: 351 - protein, 143 aa, Homo sapiens
  SITE (85): Xaa equals any of the naturally occurring L-amino acids
  SITE (131): Xaa equals any of the naturally occurring L-amino acids
  SITE (143): Xaa equals stop translation
MTKALLIYLVSSFLALNQASLISRCDLAQVLQLEDLDGFEGYSLSDWLCLAFVESKFNISKINENADGSFDYGLFQINSHYWCNXYKSYSENLCHVDCQDLLNPNLLAGIHCAKRIVSGARGMNNWVRMEXCTVQAGHSSTGX

SEQ ID NO: 352 - protein, 95 aa, Homo sapiens
  SITE (95): Xaa equals stop translation
MLVIAGGILAALLLLIVVVLCLYFKIHNALKAAKEPEAVAVKNHNPDKVWWAKNSQAKTIATESCPALQCCEGYRMCASFDSLPPCCCDINEGLX

SEQ ID NO: 353 - protein, 38 aa, Homo sapiens
  SITE (38): Xaa equals stop translation
MLLKSNILMLNLFAANVGANFALTVEKIGMILLNVSGX

SEQ ID NO: 354 - protein, 39 aa, Homo sapiens
  SITE (39): Xaa equals stop translation
MLVVAFGLLVLYILLASSWKRPEPGILTDRQPLLHDGEX

SEQ ID NO: 355 - protein, 71 aa, Homo sapiens
  SITE (35): Xaa equals any of the naturally occurring L-amino acids
  SITE (71): Xaa equals stop translation
SDPLASASQNAGIVSVGLCTRPGPQFKNAQPPFPXQKAPRCLWENQPPPWRKAWDLPSHLGRRGICGKSFX

SEQ ID NO: 356 - protein, 227 aa, Homo sapiens
MADLLGSILSSMEKPPSLGDQETRRKAREQAARLKKLQEQEKQQKVEFRKRMEKEVSDFIQDSGQIKKKFQPMNKIERSILHDVVEVAGLTSFSFGEDDDCRYVMIFKKEFAPSDEELDSYRRGEEWDPQKAEEKRKLKELAQRQEEEAAQQGPVVVSPASDYKDKYSHLIGKGAAKDAAHMLQANKTYGCVPVANKRDTRSIEEAMNEIRAKKRLRQSGEELPPTS

SEQ ID NO: 357 - protein, 90 aa, Homo sapiens
  SITE (50): Xaa equals any of the naturally occurring L-amino acids
  SITE (53): Xaa equals any of the naturally occurring L-amino acids
  SITE (59): Xaa equals any of the naturally occurring L-amino acids
  SITE (60): Xaa equals any of the naturally occurring L-amino acids
  SITE (61): Xaa equals any of the naturally occurring L-amino acids
  SITE (64): Xaa equals any of the naturally occurring L-amino acids
  SITE (65): Xaa equals any of the naturally occurring L-amino acids
  SITE (90): Xaa equals stop translation
MWDWDWSAPWSWPLWLSLALVCLSAGAKGHRASEAGHARALTCEMGSEFXTAXGLVLGXXXWTXXNGSAGPERRGWRPAAFLAVFLLGDX

SEQ ID NO: 358 - protein, 48 aa, Homo sapiens
  SITE (41): Xaa equals any of the naturally occurring L-amino acids
MFGPTFHSLVLVPPWPNLSLLHFTSPVGQHSSFLPTSLRLXKKKKKKK

SEQ ID NO: 359 - protein, 56 aa, Homo sapiens
  SITE (56): Xaa equals stop translation
MCSKNGFLLAWSWNSPWLPQASLAHGCWGRWMSDLVGCSRENKCALRDHSERVQGX

SEQ ID NO: 360 - protein, 222 aa, Homo sapiens
  SITE (4): Xaa equals any of the naturally occurring L-amino acids
  SITE (222): Xaa equals stop translation
SPLXFCVVLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEHLEKHRKDKAHKRYLLMSIDQRKKMLKNLRNTNYDVFEKICWGLGIEYTFPPLYYRRAHRRFVTKKALCIRVFQETQKLKKRRRALKAAAAAQKQAKRRNPDSPAKAIPKTLKDSQX

SEQ ID NO: 361 - protein, 64 aa, Homo sapiens
  SITE (64): Xaa equals stop translation
MGAPAASLLLLLLLFACCWAPGGANLSQDDSQPWTSDETVVAGGTVVLKCQVKDHEDSSLQWSX

SEQ ID NO: 362 - protein, 154 aa, Homo sapiens
  SITE (111): Xaa equals any of the naturally occurring L-amino acids
  SITE (124): Xaa equals any of the naturally occurring L-amino acids
  SITE (125): Xaa equals any of the naturally occurring L-amino acids
  SITE (135): Xaa equals any of the naturally occurring L-amino acids
  SITE (144): Xaa equals any of the naturally occurring L-amino acids
  SITE (154): Xaa equals stop translation
MVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAEXHLSGKIGAKKLRXXEEKQARKAQXEAEEAEREXRKRLESQREX

SEQ ID NO: 363 - protein, 17 aa, Homo sapiens
  SITE (17): Xaa equals stop translation
MQKCMLSALVFHIQWSX

SEQ ID NO: 364 - protein, 10 aa, Homo sapiens
  SITE (10): Xaa equals stop translation
MLVCSFLFLX

SEQ ID NO: 365 - protein, 14 aa, Homo sapiens
  SITE (14): Xaa equals stop translation
VIELCVSLRSLNFX

SEQ ID NO: 366 - protein, 18 aa, Homo sapiens
  SITE (5): Xaa equals any of the naturally occurring L-amino acids
  SITE (6): Xaa equals any of the naturally occurring L-amino acids
  SITE (7): Xaa equals any of the naturally occurring L-amino acids
  SITE (10): Xaa equals any of the naturally occurring L-amino acids
  SITE (18): Xaa equals stop translation
MCEFXXXIMXLAGYFACX

SEQ ID NO: 367 - protein, 62 aa, Homo sapiens
  SITE (62): Xaa equals stop translation
MVGGYVSSFSFPPVSSSLLLPASFAFPFLPGTPCPFLYFLPSPFSPLPLSLTRSNSFLLNGX

SEQ ID NO: 368 - protein, 33 aa, Homo sapiens
  SITE (33): Xaa equals stop translation
EKKSMSVSDIYALESLGRSLFTLNSMCLPLSFX

SEQ ID NO: 369 - protein, 245 aa, Homo sapiens
  SITE (79): Xaa equals any of the naturally occurring L-amino acids
MGGASRRVESGAWAYLSPLVLRKELESLVENEGSEVLALPELPSAHPIIFWNLLWYFQRLRLPSILPGLVLASCDGPSXSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 370 - protein, 35 aa, Homo sapiens
  SITE (35): Xaa equals stop translation
MKFSLLFLPMLLILKPDLFHISICTLAACGLTFPX

SEQ ID NO: 371 - protein, 22 aa, Homo sapiens
  SITE (22): Xaa equals stop translation
MLFFFILHLLSIMSFLSPDIMX

SEQ ID NO: 372 - protein, 98 aa, Homo sapiens
  SITE (82): Xaa equals any of the naturally occurring L-amino acids
MFGLLVESQTLLEENAVQGTERTLGLNIAPFINQFQVPIRVFLDLSSLPCIPLSKPVELLRLDLMTPYLNTSNREVKVYVCXIWEDLTAIPFWVSYVP

SEQ ID NO: 373 - protein, 78 aa, Homo sapiens
  SITE (7): Xaa equals any of the naturally occurring L-amino acids
  SITE (42): Xaa equals any of the naturally occurring L-amino acids
  SITE (43): Xaa equals any of the naturally occurring L-amino acids
MFGAHRXWQGSVLLFLSFAWGNGGSVTFSDVPRVMPLAGGPXXQVSSTPRPPPHQVTSSPGLESAHIVCPERKKKKKK

SEQ ID NO: 374 - protein, 31 aa, Homo sapiens
  SITE (4): Xaa equals any of the naturally occurring L-amino acids
  SITE (7): Xaa equals any of the naturally occurring L-amino acids
  SITE (20): Xaa equals any of the naturally occurring L-amino acids
  SITE (25): Xaa equals any of the naturally occurring L-amino acids
  SITE (28): Xaa equals any of the naturally occurring L-amino acids
  SITE (31): Xaa equals stop translation
TLLXFLXLLTTEGGRENIFXGRILXLQXSPX

SEQ ID NO: 375 - protein, 57 aa, Homo sapiens
  SITE (32): Xaa equals any of the naturally occurring L-amino acids
  SITE (57): Xaa equals stop translation
MLSFFICLLIFVHLLLLSFLISDWPPPTGSAXHKILRLMVVQRLSLLDQRKRWSEAX

SEQ ID NO: 376 - protein, 63 aa, Homo sapiens
  SITE (14): Xaa equals any of the naturally occurring L-amino acids
MCHHAWLIFKFFVXMGSHYVAQAGFRFLCSRDSANLAPQSAGITNVSHCIWPIFFFKKKMQRC

SEQ ID NO: 377 - protein, 38 aa, Homo sapiens
MTMVLCIFILGHHAREDPPSNGHITSEGAFLVNVGAPQ

SEQ ID NO: 378 - protein, 98 aa, Homo sapiens
  SITE (45): Xaa equals any of the naturally occurring L-amino acids
MLRLEARATTPGLQTHSCLGFYIKYEHKNTFPKYSLWLCLTLGTXPSTSSILRYVRGVYRGLEYIRFFSNSSSSRRRLTTSLGFKVSGLKFPPEITIR

SEQ ID NO: 379 - protein, 15 aa, Homo sapiens
  SITE (15): Xaa equals stop translation
TLTSFLELPLAPEPX

SEQ ID NO: 380 - protein, 34 aa, Homo sapiens
  SITE (34): Xaa equals stop translation
MHRYITFFKCFRSVILDLLFILSPLSQGCFILFX

SEQ ID NO: 381 - protein, 66 aa, Homo sapiens
  SITE (14): Xaa equals any of the naturally occurring L-amino acids
  SITE (62): Xaa equals any of the naturally occurring L-amino acids
MFGFIFLLLIFCIXLCSRTLSTFIPKLVGFLYWKFSINLSLLLTLIKKKKKKKKTPRGGPGXQSPP

SEQ ID NO: 382 - protein, 317 aa, Homo sapiens
  SITE (207): Xaa equals any of the naturally occurring L-amino acids
MPGLGRPRQARWTLMLLLSTAMYGAHAPLLALCHVDGRVPFRPSSAVLLTELTKLLLCAFSLLVGWQAWPQGPPPWRQAAPFALSALLYGANNNLVIYLQRYMDPSTYQVLSNLKIGSTAVLYCLCLRHRLSVRQGLALLLLMAAGACYAAGGLQVPGNTLPSPPPAAAASPMPLHITPLGLLLLILYCLISGLSSVYTELLMKRQXLPLALQNLFLYTFGVLLNLGLHAGGGSGPGLLEGFSGWAALVVLSQALNGLLMSAVMKHGSSITRLFVVSCSLVVNAVLSAVLLRLQLTAAFFLATLLIGLAMRLYYGSR

SEQ ID NO: 383 - protein, 31 aa, Homo sapiens
  SITE (20): Xaa equals any of the naturally occurring L-amino acids
  SITE (23): Xaa equals any of the naturally occurring L-amino acids
  SITE (31): Xaa equals stop translation
MGEQPHFSLCVLLAAVREDXDPXVFPCCFLX

SEQ ID NO: 384 - protein, 43 aa, Homo sapiens
  SITE (43): Xaa equals stop translation
MSFIALHPLLPEAALGVPGQSPHRPLWQTQCCVAPPQPRAEFX

SEQ ID NO: 385 - protein, 255 aa, Homo sapiens
  SITE (255): Xaa equals stop translation
MVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQRX

SEQ ID NO: 386 - protein, 20 aa, Homo sapiens
  SITE (2): Xaa equals any of the naturally occurring L-amino acids
  SITE (20): Xaa equals stop translation
MXGPWGEEALIRLPTPSGLX

SEQ ID NO: 387 - protein, 64 aa, Homo sapiens
  SITE (6): Xaa equals any of the naturally occurring L-amino acids
  SITE (64): Xaa equals stop translation
MATLEXNQREVDREIRSLLLWFLLCEIVSGWLCPEGPWFSQGCQIYKNLSSSSSYNLSFLLSLX

SEQ ID NO: 388 - protein, 40 aa, Homo sapiens
  SITE (40): Xaa equals stop translation
MIHSGCTSQCLEGFFLIFLLDFNPVLALDLIGIMRKASHX

SEQ ID NO: 389 - protein, 35 aa, Homo sapiens
  SITE (35): Xaa equals stop translation
MVFSARVSLYTRFKVILLSLLIMILHVCWVWVILX

SEQ ID NO: 390 - protein, 11 aa, Homo sapiens
  SITE (11): Xaa equals stop translation
GLLYIMYCNIX

SEQ ID NO: 391 - protein, 64 aa, Homo sapiens
  SITE (64): Xaa equals stop translation
MNNGLLQQPSALMLLPCRPVLTSVALNANFVSWKSRTKYTITPVKMRKSGGRDHTGGNKDRGIX

SEQ ID NO: 392 - protein, 19 aa, Homo sapiens
  SITE (19): Xaa equals stop translation
MRKQRLVPMYLGLIYILLX

SEQ ID NO: 393 - protein, 43 aa, Homo sapiens
MEISVIKIFQDETTLKIKLCLVSLSSLLVSLLLLILPESTSLW

SEQ ID NO: 394 - protein, 17 aa, Homo sapiens
  SITE (17): Xaa equals stop translation
LLLPVLASSVPSHSATX

SEQ ID NO: 395 - protein, 84 aa, Homo sapiens
  SITE (84): Xaa equals stop translation
MLPLLLFTYLNSFLHQRIPQSVRILGSLVAILLVFLITAILVKVQLDALPFFVITMIKIVLINSFGAILQGSLFGLAGLLPASX

SEQ ID NO: 396 - protein, 21 aa, Homo sapiens
  SITE (19): Xaa equals any of the naturally occurring L-amino acids
  SITE (21): Xaa equals stop translation
MKLSLFLILSDVFYLGSPXTX

SEQ ID NO: 397 - protein, 29 aa, Homo sapiens
  SITE (29): Xaa equals stop translation
MGTRRKGVAWLSLAPLITGLAPAHITAVX

SEQ ID NO: 398 - protein, 34 aa, Homo sapiens
  SITE (34): Xaa equals stop translation
MKDLLQRNPWKNSLLLLQVCQAFLVCSLTQLAVX

SEQ ID NO: 399 - protein, 47 aa, Homo sapiens
  SITE (47): Xaa equals stop translation
MSESHKIWWCYRHLAFPLLTLILYPATLGRSVFCHDCKFPEASPAMX

SEQ ID NO: 400 - protein, 25 aa, Homo sapiens
  SITE (21): Xaa equals any of the naturally occurring L-amino acids
  SITE (25): Xaa equals stop translation
MLNRIMVASFGAVLVQVCRGXGQGX

SEQ ID NO: 401 - protein, 68 aa, Homo sapiens
  SITE (68): Xaa equals stop translation
MQLLLLGLIRSQPSPPPSLCLMLCPCLPCLRYSPFVPQHPCPLPLDLCLAGCSSLSVQDKCSWPYPIX

SEQ ID NO: 402 - protein, 85 aa, Homo sapiens [sequence omitted]

SEQ ID NO: 403 - protein, 82 aa, Homo sapiens
  SITE (15): Xaa equals any of the naturally occurring L-amino acids
MGGSLLPQVSAAVLXLDGLLLPGLKGCGPLRVSFPQAKFKAAALCEALLALGWRENFKLFCSQGRGMGPGCRCPHSANESFV

SEQ ID NO: 404 - protein, 286 aa, Homo sapiens
MAMEGYWRFLALLGSALLVGFLSVIFALVWVLHYREGLGWDGSALEFNWHPVLMVTGFVFIQGIAIIVYRLPWTWKCSKLLMKSIHAGLNAVAAILAIISVVAVFENHNVNNIANMYSLHSWVGLIAVICYLLQLLSGFSVFLLPWAPLSLRAFLMPIHVYSGIVIFGTVIATALMGLTEKLIFSLRDPAYSTFPPEGVFVNTLGLLILVFGALIFWIVTRPQWKRPKEPNSTILHPNGGTEQGARGSMPAYSGNNMDKSDSELNSEVAARKRNLALDEAGQRSTM

SEQ ID NO: 405 - protein, 154 aa, Homo sapiens
  SITE (68): Xaa equals any of the naturally occurring L-amino acids
  SITE (72): Xaa equals any of the naturally occurring L-amino acids
  SITE (83): Xaa equals any of the naturally occurring L-amino acids
  SITE (103): Xaa equals any of the naturally occurring L-amino acids
  SITE (110): Xaa equals any of the naturally occurring L-amino acids
  SITE (121): Xaa equals any of the naturally occurring L-amino acids
  SITE (123): Xaa equals any of the naturally occurring L-amino acids
  SITE (126): Xaa equals any of the naturally occurring L-amino acids
  SITE (134): Xaa equals any of the naturally occurring L-amino acids
  SITE (154): Xaa equals stop translation
MTKARLFRLWLVLGSVFMILLIIVYWDSAGAAHFYLHTSFSRPHTGPPLPTPGPDRDRELTADSDVDXFLDXFLSAGVKQSDXPRKETEQPPAPGSMEESVRXYDWSPRXARRTQTRAGSXRXGGXCCGASAPXPAWPSPPRSAHSTTSPTRSX

SEQ ID NO: 406 - protein, 37 aa, Homo sapiens [sequence omitted]

SEQ ID NO: 407 - protein, 60 aa, Homo sapiens [sequence omitted]

SEQ ID NO: 408 - protein, 447 aa, Homo sapiens
  SITE (447): Xaa equals stop translation
MLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELRX

SEQ ID NO: 409 - protein, 64 aa, Homo sapiens
MLYSDLKLVRCHNGPVHVISVYTTPPDPSNPYNTPPLFASCMVISYVTFTPVSADCFFNVLVCF

SEQ ID NO: 410 - protein, 24 aa, Homo sapiens
  SITE (24): Xaa equals stop translation
ELLFLLIIILGESLSDVILLICFX

SEQ ID NO: 411 - protein, 35 aa, Homo sapiens
  SITE (35): Xaa equals stop translation
MFYWGGLSFYFLLSSGVGFYCFLFGFGMEIWIAAX

SEQ ID NO: 412 - protein, 41 aa, Homo sapiens
MGKVGWLMVGGVAPGIRGGWGWTLGIMVGGAIAHCCCCLIR

SEQ ID NO: 413 - protein, 25 aa, Homo sapiens
  SITE (25): Xaa equals stop translation
MKLSLLILTLMQRYFRTITNSLCKX

SEQ ID NO: 414 - protein, 79 aa, Homo sapiens
  SITE (79): Xaa equals stop translation
MPAVSGPGPLFCLLLLLLDPHSPETGCPPLRRFEYKLSFKGPRLALPGAGIPFWSHHGGEGQGWGPLCPGSLKVLEGLX

SEQ ID NO: 415 - protein, 51 aa, Homo sapiens
  SITE (20): Xaa equals any of the naturally occurring L-amino acids
  SITE (28): Xaa equals any of the naturally occurring L-amino acids
MHYLLKECDIDTDAYFFFFXLLVLFLPXKYSPPFYSIVLFRWNDSYKISHY

SEQ ID NO: 416 - protein, 257 aa, Homo sapiens
  SITE (100): Xaa equals any of the naturally occurring L-amino acids
MAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVXSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTEDTIPRNTDRKKENKPVFFQQI

SEQ ID NO: 417 - protein, 424 aa, Homo sapiens
  SITE (144): Xaa equals any of the naturally occurring L-amino acids
  SITE (263): Xaa equals any of the naturally occurring L-amino acids
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKXRLNWIQWASLLTLFLSIVALTAGTKTLQHNLAGRGFHHDAFFSPSNSCLLFRNECPRKDNCTAKEWTFPEAKWNTTARVFSHIRLGMGHVLIIVQCFISSMANIYNEKILKEGNQLTEXIFIQNSKLYFFGILFNGLTLGLQRSNRDQIKNCGFFYGHSAFSVALIFVTAFQGLSVAFILKFLDNMFHVLMAQVTTVIITTVSVLVFDFRPSLEFFLEAPSVLLSIFIYNASKPQVPEYAPRQERIRDLSGNLWERSSGDGEELERLTKPKSDESDEDTF

SEQ ID NO: 418 - protein, 33 aa, Homo sapiens
  SITE (33): Xaa equals stop translation
MWGQGSQKSHFSDLVFGVRELCAQPSDPGSPHX

SEQ ID NO: 419 - protein, 80 aa, Homo sapiens
  SITE (53): Xaa equals any of the naturally occurring L-amino acids
  SITE (80): Xaa equals stop translation
MVQHIQPAALSLLAQWSTLVQELEAALQLAFYPDAVEEWLEENVHPSLQRLQXLLQDLSEVSAPPLPPTSPGRDVAQDPX

SEQ ID NO: 420 - protein, 95 aa, Homo sapiens
  SITE (82): Xaa equals any of the naturally occurring L-amino acids
  SITE (83): Xaa equals any of the naturally occurring L-amino acids
  SITE (95): Xaa equals stop translation
MLNQGYIRKIILIIILGSFSSPKKAILMGFQNQKKALNEEQTTGVPMSISGKLRPSRSLDFVQPPRFQSQQPSAVVDRRGFXXKAARGQEFSESX

SEQ ID NO: 421 - protein, 257 aa, Homo sapiens
MRGPAQAKLLPGSAIQALVGLARPLVLALLLVSAALSSVVSRTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDDTLEENRGYMEIEQSVKSFKMPSSNIEEEDSHFFFHLIIFAFCIAVVYITYHNKRKIFLLVQSRKWRDGLCSKTVEYHRLDQNVNEAMPSLKITNDYIF

SEQ ID NO: 422 - protein, 704 aa, Homo sapiens
MWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 423 - protein, 190 aa, Homo sapiens
  SITE (29): Xaa equals any of the naturally occurring L-amino acids
  SITE (31): Xaa equals any of the naturally occurring L-amino acids
MKASQCCCCLSHLLASVLLLLLLPELSGXLXVLLQAAEAAPGLGPPDPRPRTLPPLPPGPTPAQQPGRGLAEAAGPRGSEGGNGSNPVAGLETDDHGGKAGEGSVGGGLAVSPNPGDKPMTQRALTVLMVVSGAVLVYFVVRTVRMRRRNRKTRRYGVLDTNIENMELTPLEQDDEDDDNTLFDANHPRR

SEQ ID NO: 424 - protein, 179 aa, Homo sapiens
  SITE (179): Xaa equals stop translation
MSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSGKCRQLSRLCRNHCRX

SEQ ID NO: 425 - protein, 40 aa, Homo sapiens
MFKCLQTTFLFILDFTWESKVQFHKASVYLSLSIYIDCHA

SEQ ID NO: 426 - protein, 232 aa, Homo sapiens
MLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKGKALMYRLHHYSDF

SEQ ID NO: 427 - protein, 250 aa, Homo sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 428 - protein, 58 aa, Homo sapiens
MWTKNDKLKKFFFLRYLQNMVYFYVEKKSYEGSCYFKRKFIKSPRGMKMTACFSIILA

SEQ ID NO: 429 - protein, 219 aa, Homo sapiens
  SITE (61): Xaa equals any of the naturally occurring L-amino acids
  SITE (105): Xaa equals any of the naturally occurring L-amino acids
  SITE (117): Xaa equals any of the naturally occurring L-amino acids
  SITE (219): Xaa equals stop translation
MAVVLLANLAQGDSLAARAIAVQKGSIGNLLGFLEDSLAATQFQQSQASLLHMQNPPFEPXSVDMMRRAARALLALAKVDENHSEFTLYESRLLDISVSPLMNSXVSQVICDVLFLXWPVMTAVGHLPPPCVCACVENLETDCCPLFMQNHLRIQFTLCCPASPLGKSLSCFSLLLPPPLPPSPHAFLFLVLTLLPSGPYPTLFEKTKLCLHRRLFLFX

SEQ ID NO: 430 - protein, 51 aa, Homo sapiens
  SITE (51): Xaa equals stop translation
MLPDESFGLLLSIPSLTPSAAAPSFCVHLMQASRSSKRASHVPVHLLWGDX

SEQ ID NO: 431 - protein, 50 aa, Homo sapiens
  SITE (27): Xaa equals any of the naturally occurring L-amino acids
  SITE (50): Xaa equals stop translation
MRPGSFSFIAFLATEVSSCFPGRPDCXTGMWLLQLQKKQRTLLAMAPRRX

SEQ ID NO: 432 - protein, 70 aa, Homo sapiens
  SITE (33): Xaa equals any of the naturally occurring L-amino acids
  SITE (39): Xaa equals any of the naturally occurring L-amino acids
  SITE (55): Xaa equals any of the naturally occurring L-amino acids
  SITE (70): Xaa equals stop translation
DRPCPSSLWKVFPLLLLLMRLFPLPVPGNQRAXLPHPFXAPRLPCLLCLCTQQFXVCSHYLPAGYRVNSX

SEQ ID NO: 433 - protein, 40 aa, Homo sapiens
  SITE (40): Xaa equals stop translation
MHEKAWNLILLWWLSLDLLGVAKTAMWAQWCGLNDHKGKX

SEQ ID NO: 434 - protein, 104 aa, Homo sapiens
MAFVLLFCFVGLQSSRAGPYSELVLCQTPASAPDPVSTLCVLEEEPLDAYPDSPSACLVLNWEEPCNNGSEILAYTIDLGDTSITVGNTTMHVMKDLLPETTYR

SEQ ID NO: 435 - protein, 38 aa, Homo sapiens
  SITE (38): Xaa equals stop translation
MFSLLWLVCVPSNSSVANVTASRGGVFKRSLGHEGFSX

SEQ ID NO: 436 - protein, 35 aa, Homo sapiens
  SITE (35): Xaa equals stop translation
KWLLFIFLLCLQLVNALLSLFQERFVHCPARFVSX

SEQ ID NO: 437 - protein, 32 aa, Homo sapiens
  SITE (32): Xaa equals stop translation
MLLFLSITNSLSFISVDKPFGQSEDVCPVISX

SEQ ID NO: 438 - protein, 127 aa, Homo sapiens
  SITE (127): Xaa equals stop translation
MEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMSX

SEQ ID NO: 439 - protein, 69 aa, Homo sapiens
  SITE (10): Xaa equals any of the naturally occurring L-amino acids
  SITE (69): Xaa equals stop translation
MTWHSRESFXLLRVVAPSQAPGMQVSPSQRAWRRPLHRCHVAAPRPHHFAFFRNPFSWSFIKLLYRYLX

SEQ ID NO: 440 - protein, 92 aa, Homo sapiens
  SITE (92): Xaa equals stop translation
MGLKLNGRYISLILAVQIAYLVQAVRAAGKCDAVFKGFSDCLLKLGDTWPTTRSLGRQDEHQDRVHILGGFPQLHGHSPYGLPGRGERYVGX

SEQ ID NO: 441 - protein, 380 aa, Homo sapiens
  SITE (264): Xaa equals any of the naturally occurring L-amino acids
  SITE (296): Xaa equals any of the naturally occurring L-amino acids
  SITE (380): Xaa equals stop translation
MARRSAFPAAALWLWSILLCLLALRAEAGPPQEESLYLWIDAHQARVLIGFEEDILIVSEGKMAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNERRICECPDGFHGPHCEKALCTPRCMNGGLCVTPGFCICPPGFYGVNCDKANCSTTCFNGGTCFYPGKCIXPPGLEGEQCEISKCPQPCRNGGKCIGKSKCKXSKGYQGDLCSKPVCEPGCGAHGTCHEPNKCQCQEGWHGRHCNKRYEASLIHALRPAGAQLRQHTPSLKKAEERRDPPESNYIWX

SEQ ID NO: 442 - protein, 24 aa, Homo sapiens
  SITE (17): Xaa equals any of the naturally occurring L-amino acids
  SITE (21): Xaa equals any of the naturally occurring L-amino acids
  SITE (23): Xaa equals any of the naturally occurring L-amino acids
  SITE (24): Xaa equals stop translation
MTSNLLLLTLLLKDTLXLAKXNXX

SEQ ID NO: 443 - protein, 47 aa, Homo sapiens
  SITE (33): Xaa equals any of the naturally occurring L-amino acids
  SITE (47): Xaa equals stop translation
MRHHTQLNFIFLVEMVFLHVGQAGLKLPTSGDXACFGLPKVLGLQAX

SEQ ID NO: 444 - protein, 214 aa, Homo sapiens
MQVTITLTSPIIREENMREGDVTSGMVKDPPDVLDRQKCLDALAALRHAKWFQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGVDGFEAEGKKDKKDYDNF

SEQ ID NO: 445 - protein, 144 aa, Homo sapiens
  SITE (144): Xaa equals stop translation
LLSILLCLLASGLVVFFLFPHSVLVDDDGIKVVKVTFNKQDSLVILTIMATLKIRNSNFYTVAVTSLSSQIQYMNTVVNFTGKAEMGGPFSYVYFFCTVPEILVHNIVIFMRTSVKISYIGLMTQSSLETHHYVDCGGNSTAIX

SEQ ID NO: 446 - protein, 37 aa, Homo sapiens
  SITE (37): Xaa equals stop translation
MFFFLYVYSVLCGLLVYPSLPSHSVSLVTSLVASALX

SEQ ID NO: 447 - protein, 37 aa, Homo sapiens
  SITE (31): Xaa equals any of the naturally occurring L-amino acids
  SITE (37): Xaa equals stop translation
MASINAVYIHVFLGVCVQATAACPWCSQCRXGSVPSX

SEQ ID NO: 448 - protein, 192 aa, Homo sapiens
  SITE (47): Xaa equals any of the naturally occurring L-amino acids
  SITE (192): Xaa equals stop translation
MMAAMVLTSLSCSPVVQSPPGTEANFSASRAACDPWKESGDISDSGXSTTSGHWSGSSGVSTPSPPHPQASPKYLGDAFGSPQTDHGFETDPDPFLLDEPAPRKRKNSVKVMYKCLWPNCGKVLRSIVGIKRHVKALHLGDTVDSDQFKREEDFYYTEVQLKEESAAAAAAAAADPQSLGLPPPSQLPPPAX

SEQ ID NO: 449 - protein, 31 aa, Homo sapiens
  SITE (31): Xaa equals stop translation
MSTNYLTDVCSLFSYLNYLYFHHHLPVPNTX

SEQ ID NO: 450 - protein, 101 aa, Homo sapiens
  SITE (44): Xaa equals any of the naturally occurring L-amino acids
  SITE (46): Xaa equals any of the naturally occurring L-amino acids
  SITE (77): Xaa equals any of the naturally occurring L-amino acids
  SITE (78): Xaa equals any of the naturally occurring L-amino acids
  SITE (101): Xaa equals stop translation
MGFFFVLFFLYLALSRDWSINFLKDHRINFFVATSYFSVYVRGXPXVPADTPLGPLLSLWLHHNAFFSILPKFPENXXFLILKKLVVEMGWDLFISPENKX

SEQ ID NO: 451 - protein, 37 aa, Homo sapiens
  SITE (37): Xaa equals stop translation
MARYFIFFILVFMKVSLNTTWPAPRPATLRTANKSKX

SEQ ID NO: 452 - protein, 42 aa, Homo sapiens
  SITE (42): Xaa equals stop translation
FSTIRSGLTDRSVNFLFLFLDVPDCRLVNIELMANSTVTHAX

SEQ ID NO: 453 - protein, 48 aa, Homo sapiens [sequence omitted]

SEQ ID NO: 454 - protein, 25 aa, Homo sapiens
  SITE (25): Xaa equals stop translation
MPWRRAGLMMLPIITGCCPCSASIX

SEQ ID NO: 455 - protein, 54 aa, Homo sapiens [sequence omitted]

SEQ ID NO: 456 - protein, 42 aa, Homo sapiens
  SITE (42): Xaa equals stop translation
MTALVWRKGPDGGSRKPILLLFFFLPLILCFHSFIHSSNICX

SEQ ID NO: 457 - protein, 66 aa, Homo sapiens
  SITE (15): Xaa equals any of the naturally occurring L-amino acids
  SITE (66): Xaa equals stop translation
MFLTTWFLLLSVAWXALTRSGRSCLPLVGRPREQSPRTHCAASSTKERNSDPQPSPPEVVGPLWSX

SEQ ID NO: 458 - protein, 156 aa, Homo sapiens
MKAIGIEPSLATYHHIIRLFDQPGDPLKRSSFIIYDIMNELMGKRFSPKDPDDDKFFQSAMSICSSLRDLELAYQVHGLLKTGDNWKFIGPDQHRNFYYSKFFDLICLMEQIDVTLKWYEDLIPSAYFPHSQTMIHLLQALDVANRLEVIPKIWER

SEQ ID NO: 459 - protein, 31 aa, Homo sapiens
  SITE (31): Xaa equals stop translation
MNDNSPNHSSSYLPLPLTIVILQTGHKGTLX

SEQ ID NO: 460 - protein, 57 aa, Homo sapiens
  SITE (57): Xaa equals stop translation
MHFLFRFIVFFYLWGLFTAQRQKKEESTEEVKIEVLHRPENCSKTSKKGDLLKCPLX

SEQ ID NO: 461 - protein, 416 aa, Homo sapiens
  SITE (338): Xaa equals any of the naturally occurring L-amino acids
  SITE (416): Xaa equals stop translation
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQXSEHFFEYKKSRSGRHVVFYPTLKSLQVRLELARELGVGVSIWELARAWTTSTTCSRWALRPPRWTCSFLSHGVSEQVX

SEQ ID NO: 462 - protein, 64 aa, Homo sapiens
  SITE (56): Xaa equals any of the naturally occurring L-amino acids
MAPGPLSATQAVVIHTTHCLQLPVWCLSLVSELLGRAPPHNKDALRPSKKKKKKLXGGPVPIPP

SEQ ID NO: 463 - protein, 206 aa, Homo sapiens
  SITE (80): Xaa equals any of the naturally occurring L-amino acids
  SITE (93): Xaa equals any of the naturally occurring L-amino acids
  SITE (206): Xaa equals stop translation
MLGAKPHWLPGPLHSPGLPLVLVLLALGAGWAQEGSEPVLLEGECLVVCEPGRAAAGGPGGAALGEAPPGRVAFAAVRSXHHEPAGETGNGTXGAIYFDQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPLX

SEQ ID NO: 464 - protein, 38 aa, Homo sapiens
  SITE (38): Xaa equals stop translation
MQRKVSDFIIHQRLTVNLCVISFFFFLPICIFSLAKKX

SEQ ID NO: 465 - protein, 136 aa, Homo sapiens
  SITE (136): Xaa equals stop translation
VVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRNX

SEQ ID NO: 466 - protein, 50 aa, Homo sapiens
  SITE (17): Xaa equals any of the naturally occurring L-amino acids
  SITE (18): Xaa equals any of the naturally occurring L-amino acids
  SITE (25): Xaa equals any of the naturally occurring L-amino acids
  SITE (50): Xaa equals stop translation
MCLSRWKIFYTLLILFXXFSITSEXETFYMIIIHHNPTQITASCSFTFLX

SEQ ID NO: 467 - protein, 71 aa, Homo sapiens
  SITE (27): Xaa equals any of the naturally occurring L-amino acids
  SITE (49): Xaa equals any of the naturally occurring L-amino acids
  SITE (71): Xaa equals stop translation
MWGCSGLGHRTVSFLLLLPCSFPRPCXLFGLIPISRPCKVEAPRLSVPXLSCASHPYCNCPMSTSCPLPRX

SEQ ID NO: 468 - protein, 59 aa, Homo sapiens
  SITE (59): Xaa equals stop translation
DFVPVLVFVLIKANPPCLLSTVQYISSFYASCLSGEESYWWMQFTAAVEFIKTIDDRKX

SEQ ID NO: 469 - protein, 59 aa, Homo sapiens
  SITE (27): Xaa equals any of the naturally occurring L-amino acids
  SITE (34): Xaa equals any of the naturally occurring L-amino acids
  SITE (35): Xaa equals any of the naturally occurring L-amino acids
  SITE (37): Xaa equals any of the naturally occurring L-amino acids
  SITE (38): Xaa equals any of the naturally occurring L-amino acids
  SITE (46): Xaa equals any of the naturally occurring L-amino acids
  SITE (59): Xaa equals any of the naturally occurring L-amino acids
MFSRTSNFWTFFFQFLIFKVFLVLKNXFTSQKIXXIXXEKPKKKKXRGGRAPSPQGGPX

SEQ ID NO: 470 - protein, 62 aa, Homo sapiens
  SITE (17): Xaa equals any of the naturally occurring L-amino acids
  SITE (62): Xaa equals stop translation
MSSLLSAGLQASLCGKXLWASTWYLVCCLLPFFHQGCCDHKSKQQYIPNLKSYCGLSTIEIX

SEQ ID NO: 471 - protein, 316 aa, Homo sapiens
  SITE (103): Xaa equals any of the naturally occurring L-amino acids
  SITE (302): Xaa equals any of the naturally occurring L-amino acids
  SITE (305): Xaa equals any of the naturally occurring L-amino acids
  SITE (316): Xaa equals stop translation
MSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMXFILQLDIAFKLNNQIRENAEVSMDVSLAYRDDAFAEWTEMAHERVPRKLKCTFTSPKTPEHGGPVTMNVMSFLSWKLGLWPMKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQASSMXCFXPSGSSSVASTX

SEQ ID NO: 472 - protein, 24 aa, Homo sapiens
  SITE (24): Xaa equals stop translation
MLALLGLLAGTEHPPGPQGPGPSX

SEQ ID NO: 473 - protein, 10 aa, Homo sapiens
  SITE (10): Xaa equals stop translation
MPSGACCSPX

SEQ ID NO: 474 - protein, 85 aa, Homo sapiens
  SITE (36): Xaa equals any of the naturally occurring L-amino acids
  SITE (44): Xaa equals any of the naturally occurring L-amino acids
  SITE (85): Xaa equals stop translation
YVMIFKKEFAPSDEELDSYRRGEEWDPQKAEEKRNXKELAQRQXGGGSPAGACGGEPCQRLQGQVQPPHRQGSSQRRSPHATGQX

SEQ ID NO: 475 - protein, 26 aa, Homo sapiens
  SITE (26): Xaa equals stop translation
MLPALSTVLLPTPSLCSGNPREGWAX

SEQ ID NO: 476 - protein, 34 aa, Homo sapiens
  SITE (34): Xaa equals stop translation
KEFFVFLFVCLFWLLSNTPLTFISIILQRKETNX

SEQ ID NO: 477 - protein, 172 aa, Homo sapiens
  SITE (151): Xaa equals any of the naturally occurring L-amino acids
  SITE (172): Xaa equals stop translation
MYSLHSWVGLIAVICYLLQLLSGFSVFLLPWAPLSLRAFLMPIHVYSGIVIFGTVIATALMGLTEKLIFSLRDPAYSTFPPEGVFVNTLGLLILVFGALIFWIVTRPQWKRPKEPNSTILHPNGGTEQGARGSMPAYSGNNMDKSDSELNXEVAARKRNLALDEAGQRSTMX

SEQ ID NO: 478 - protein, 61 aa, Homo sapiens
  SITE (8): Xaa equals any of the naturally occurring L-amino acids
  SITE (27): Xaa equals any of the naturally occurring L-amino acids
  SITE (61): Xaa equals stop translation
MCIHVFMXVLWVLFLLNPLCTGLWPLXNCFSVLRHADWVLGADYKGEELNRHQGPMKPKDX

SEQ ID NO: 479 - protein, 3 aa, Homo sapiens
  SITE (3): Xaa equals stop translation
GRX

SEQ ID NO: 480 - protein, 96 aa, Homo sapiens
  SITE (11): Xaa equals any of the naturally occurring L-amino acids
  SITE (35): Xaa equals any of the naturally occurring L-amino acids
  SITE (38): Xaa equals any of the naturally occurring L-amino acids
  SITE (96): Xaa equals stop translation
MFHVLMAQVTXVIITTVSVLVFDFRPSLEFFLEAXSVXLSIFIYNASKPQVPEYAPRQERIRDLSGNLWERSSGDGEELERLTKPKSDESDEDTFX

SEQ ID NO: 481 - protein, 171 aa, Homo sapiens
  SITE (159): Xaa equals any of the naturally occurring L-amino acids
  SITE (171): Xaa equals stop translation
MRGPAQAKLLPGSAIQALVGLARPLVLALLLVSAALSSVVSRTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDXHLGRKQGLHGNX

SEQ ID NO: 482 - protein, 623 aa, Homo sapiens
  SITE (111): Xaa equals any of the naturally occurring L-amino acids
  SITE (575): Xaa equals any of the naturally occurring L-amino acids
MFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLXGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLEVXKFMRLKPVPENHPQWDTAIEGDEDQEDSEGFEDSFEGGRGREEGRWWT

SEQ ID NO: 483 - protein, 92 aa, Homo sapiens
  SITE (29): Xaa equals any of the naturally occurring L-amino acids
  SITE (31): Xaa equals any of the naturally occurring L-amino acids
  SITE (43): Xaa equals any of the naturally occurring L-amino acids
  SITE (92): Xaa equals stop translation
MKASQCCCCLSHLLASVLLLLLLPELSGXLXVLLQAAEAAPGXGPPDPRPGHYRRCHRALTPAQQPGRGLAEAAGAAGLRGRQWQQPCGRAX

SEQ ID NO: 484 - protein, 14 aa, Homo sapiens
  SITE (13): Xaa equals any of the naturally occurring L-amino acids
  SITE (14): Xaa equals stop translation
MFKCLQTTFLFIXX

SEQ ID NO: 485 - protein, 54 aa, Homo sapiens
  SITE (54): Xaa equals stop translation
ILLCSWPTGLVGGRDPGSSRGSSASLTPSPGRQPCSRRRGYSVGRRSSPPDGSX

SEQ ID NO: 486 - protein, 22 aa, Homo sapiens
  SITE (7): Xaa equals any of the naturally occurring L-amino acids
  SITE (11): Xaa equals any of the naturally occurring L-amino acids
  SITE (16): Xaa equals any of the naturally occurring L-amino acids
  SITE (22): Xaa equals stop translation
MAFVLLXCFVXLQSSXGRAVQX

SEQ ID NO: 487 - protein, 19 aa, Homo sapiens
ENMICVKCLPQYPEHSKHV

SEQ ID NO: 488 - protein, 20 aa, Homo sapiens [sequence omitted]

SEQ ID NO: 489 - protein, 20 aa, Homo sapiens
ELVESPGAAGNSARSGNVVC

SEQ ID NO: 490 - protein, 25 aa, Homo sapiens
  SITE (9): Xaa equals any of the naturally occurring L-amino acids
FKKLVNPRXQGIRHEEEAVSWQERR

SEQ ID NO: 491 - protein, 206 aa, Homo sapiens
  SITE (5): Xaa equals any of the naturally occurring L-amino acids
ISVLXYPHCVVHELPELTAESLEAGDSNQFCWRNLFSCINLLRILNKLTKWKHSRTMMLVVFKSAPILKRALKVKQAMMQLYVLKLLKVQTKYLGRQWRKSNMKTMSAIYQKVRHRLNDDWAYGNDLDARPWDFQAEECALRANIERFNARRYDRAHSNPDFLPVDNCLQSVLGQRVDLPEDFQMNYDLWLEREVFSKPISWEELL

SEQ ID NO: 492 - protein, 507 aa, Homo sapiens
  SITE (87): Xaa equals any of the naturally occurring L-amino acids
  SITE (95): Xaa equals any of the naturally occurring L-amino acids
MRAASPPASASDLIEQQQKRGRREHKALIKQDNLDAFNERDPYKADDSREEEEENDDDNSLEGETFPLERDEVMPPPLQHPQTDRLXCPKGLPWXPKVREKDIEMFLESSRSKFIGYTLGSDTNTVVGLPRPIHESIKTLKQHKYTSIAEVQAQMEEEYLRSPLSGGEEEVEQVPAETLYQGLLPSLPQYMIALLKILLAAAPTSKAKTDSINILADVLPEEMPTTVLQSMKLGVDVNRHKEVIVKAISAVLLLLLKHFKLNHVYQFEYMAQHLVFANCIPLILKFFNQNIMSYITAKNSISVLDYPHCVVHELPELTAESLEAGDSNQFCWRNLFSCINLLRILNKLTKWKHSRTMMLVVFKSAPILKRALKVKQAMMQLYVLKLLKVQTKYLGRQWRKSNMKTMSAIYQKVRHRLNDDWAYGNDLDARPWDFQAEECALRANIERFNARRYDRAHSNPDFLPVDNCLQSVLGQRVDLPEDFQMNYDLWLEREVFSKPISWEELLQ

SEQ ID NO: 493 - protein, 50 aa, Homo sapiens
MRAASPPASASDLIEQQQKRGRREHKALIKQDNLDAFNERDPYKADDSRE

SEQ ID NO: 494 - protein, 45 aa, Homo sapiens
  SITE (37): Xaa equals any of the naturally occurring L-amino acids
  SITE (45): Xaa equals any of the naturally occurring L-amino acids
EEEENDDDNSLEGETFPLERDEVMPPPLQHPQTDRLXCPKGLPWX

SEQ ID NO: 495 - protein, 51 aa, Homo sapiens
PKVREKDIEMFLESSRSKFIGYTLGSDTNTVVGLPRPIHESIKTLKQHKYT

SEQ ID NO: 496 - protein, 47 aa, Homo sapiens
SIAEVQAQMEEEYLRSPLSGGEEEVEQVPAETLYQGLLPSLPQYMIA

SEQ ID NO: 497 - protein, 48 aa, Homo sapiens
LLKILLAAAPTSKAKTDSINILADVLPEEMPTTVLQSMKLGVDVNRHK

SEQ ID NO: 498 - protein, 50 aa, Homo sapiens
EVIVKAISAVLLLLLKHFKLNHVYQFEYMAQHLVFANCIPLILKFFNQNI

SEQ ID NO: 499 - protein, 48 aa, Homo sapiens
MSYITAKNSISVLDYPHCVVHELPELTAESLEAGDSNQFCWRNLFSCI

SEQ ID NO: 500 - protein, 47 aa, Homo sapiens
NLLRILNKLTKWKHSRTMMLVVFKSAPILKRALKVKQAMMQLYVLKL

SEQ ID NO: 501 - protein, 45 aa, Homo sapiens
LKVQTKYLGRQWRKSNMKTMSAIYQKVRHRLNDDWAYGNDLDARP

SEQ ID NO: 502 - protein, 48 aa, Homo sapiens
WDFQAEECALRANIERFNARRYDRAHSNPDFLPVDNCLQSVLGQRVDL

SEQ ID NO: 503 - protein, 28 aa, Homo sapiens
PEDFQMNYDLWLEREVFSKPISWEELLQ

SEQ ID NO: 504 - protein, 317 aa, Homo sapiens
  SITE (39): Xaa equals any of the naturally occurring L-amino acids
  SITE (40): Xaa equals any of the naturally occurring L-amino acids
  SITE (112): Xaa equals any of the naturally occurring L-amino acids
MAPPAPGPASGGSGEVDELFDVKNAFYIGSYQQCINEAXXVKLSSPERDVERDVFLYRAYLAQRKFGVVLDEIKPSSAPELQAVRMFADYLAHESRRDSIVAELDREMSRSXDVTNTTFLLMAASIYLHDQNPDAALRALHQGDSLECTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSAEAGPELSGP

SEQ ID NO: 505 - protein, 261 aa, Homo sapiens
  SITE (65): Xaa equals any of the naturally occurring L-amino acids
RDVERDVFLYRAYLAQRKFGVVLDEIKPSSAPELQAVRMFADYLAHESRRDSIVAELDREMSRSXDVTNTTFLLMAASIYLHDQNPDAALRALHQGDSLECTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSA

SEQ ID NO: 506 - protein, 48 aa, Homo sapiens
  SITE (39): Xaa equals any of the naturally occurring L-amino acids
  SITE (40): Xaa equals any of the naturally occurring L-amino acids
MAPPAPGPASGGSGEVDELFDVKNAFYIGSYQQCINEAXXVKLSSPER

SEQ ID NO: 507 - protein, 47 aa, Homo sapiens
DVERDVFLYRAYLAQRKFGVVLDEIKPSSAPELQAVRMFADYLAHES

SEQ ID NO: 508 - protein, 48 aa, Homo sapiens
  SITE (17): Xaa equals any of the naturally occurring L-amino acids
RRDSIVAELDREMSRSXDVTNTTFLLMAASIYLHDQNPDAALRALHQG

SEQ ID NO: 509 - protein, 47 aa, Homo sapiens
DSLECTAMTVQILLKLDRLDLARKELKRMQDLDEDATLTQLATAWVS

SEQ ID NO: 510 - protein, 47 aa, Homo sapiens
LATGGEKLQDAYYIFQEMADKCSPTLLLLNGQAACHMAQGRWEAAEG

SEQ ID NO: 511 - protein, 48 aa, Homo sapiens
LLQEALDKDSGYPETLVNLIVLSQHLGKPPEVTNRYLSQLKDAHRSHP

SEQ ID NO: 512 - protein, 32 aa, Homo sapiens
FIKEYQAKENDFDRLVLQYAPSAEAGPELSGP

SEQ ID NO: 513 - protein, 47 aa, Homo sapiens
RDVERDVFLYRAYLAQRKFGVVLDEIKPSSAPELQAVRMFADYLAHE

SEQ ID NO: 514 - protein, 48 aa, Homo sapiens
  SITE (18): Xaa equals any of the naturally occurring L-amino acids
SRRDSIVAELDREMSRSXDVTNTTFLLMAASIYLHDQNPDAALRALHQ

SEQ ID NO: 515 - protein, 47 aa, Homo sapiens
GDSLECTAMTVQILLKLDRLDLARKELKRMQDLDEDATLTQLATAWV

SEQ ID NO: 516 - protein, 47 aa, Homo sapiens
SLATGGEKLQDAYYIFQEMADKCSPTLLLLNGQAACHMAQGRWEAAE

SEQ ID NO: 517 - protein, 38 aa, Homo sapiens
GLLQEALDKDSGYPETLVNLIVLSQHLGKPPEVTNRYL

SEQ ID NO: 518 - protein, 34 aa, Homo sapiens
SQLKDAHRSHPFIKEYQAKENDFDRLVLQYAPSA

SEQ ID NO: 519 - protein, 62 aa, Homo sapiens
NRYYRESWSLQVPVRNSGSTHASERNGASGPRPGLRRLRGGRRAVRRKERLLHRQLPAVHKR

SEQ ID NO: 520 - protein, 66 aa, Homo sapiens
  SITE (4): Xaa equals any of the naturally occurring L-amino acids
APGXGWRGSLGEPPPPPRASLSSDTSALSYDSVKYTLVVDEHAQLELVSLRRASETTVTRVTLPPS

SEQ ID NO: 521 - protein, 30 aa, Homo sapiens
  SITE (4): Xaa equals any of the naturally occurring L-amino acids
APGXGWRGSLGEPPPPPRASLSSDTSALSY

SEQ ID NO: 522 - protein, 36 aa, Homo sapiens
DSVKYTLVVDEHAQLELVSLRRASETTVTRVTLPPS

SEQ ID NO: 523 - protein, 156 aa, Homo sapiens; identical to SEQ ID NO: 458

SEQ ID NO: 524 - protein, 176 aa, Homo sapiens
KDSKEYGHTFRSDLREEILMLMARDKHPPELQVAFADCAADIKSAYESQPIRQTAQDWPATSLNCIAILFLRAGRTQEAWKMLGLFRKHNKIPRSELLNELMDSAKVSNSPSQAIEVVELASAFSLPICEGLTQRVMSDFAINQEQKEALSNLTALTSDSDTDSSSDSDSDTSEGK

SEQ ID NO: 525 - protein, 49 aa, Homo sapiens
MKAIGIEPSLATYHHIIRLFDQPGDPLKRSSFIIYDIMNELMGKRFSPK

SEQ ID NO: 526 - protein, 49 aa, Homo sapiens
DPDDDKFFQSAMSICSSLRDLELAYQVHGLLKTGDNWKFIGPDQHRNFY

SEQ ID NO: 527 - protein, 28 aa, Homo sapiens
YSKFFDLICLMEQIDVTLKWYEDLIPSA

SEQ ID NO: 528 - protein, 30 aa, Homo sapiens
YFPHSQTMIHLLQALDVANRLEVIPKIWER

SEQ ID NO: 529 - protein, 46 aa, Homo sapiens
KDSKEYGHTFRSDLREEILMLMARDKHPPELQVAFADCAADIKSAY

SEQ ID NO: 530 - protein, 50 aa, Homo sapiens
ESQPIRQTAQDWPATSLNCIAILFLRAGRTQEAWKMLGLFRKHNKIPRSE

SEQ ID NO: 531 - protein, 47 aa, Homo sapiens
LLNELMDSAKVSNSPSQAIEVVELASAFSLPICEGLTQRVMSDFAIN

SEQ ID NO: 532 - protein, 33 aa, Homo sapiens
QEQKEALSNLTALTSDSDTDSSSDSDSDTSEGK

SEQ ID NO: 533 - protein, 324 aa, Homo sapiens [sequence omitted]

SEQ ID NO: 534 - protein, 133 aa, Homo sapiens
IQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSST

SEQ ID NO: 535 - protein, 53 aa, Homo sapiens
TSDGAISVPSLSAPGQGTSSTNTVGATVNSQAAQAQPPAMTSSRKGTFTDDLH

SEQ ID NO: 536 - protein, 48 aa, Homo sapiens
KGHMNYEGPGMARKFSAPGQLCISMTSNLGGSAPISAASATSLGHFTK

SEQ ID NO: 537 - protein, 31 aa, Homo sapiens
QPLKPSPSSDNLYSAFTSDGAISVPSLSAPG

SEQ ID NO: 538 - protein, 51 aa, Homo sapiens
MSSDNESDIEDEDLKLELRRLRDKHLKEIQDLQSRQKHEIESLYTKLGKVP

SEQ ID NO: 539 - protein, 47 aa, Homo sapiens
PAVIIPPAAPLSGRRRRPTKSKGSKSSRSSSLGNKSPQLSGNLSGQS

SEQ ID NO: 540 - protein, 50 aa, Homo sapiens
AASVLHPQQTLHPPGNIPESGQNQLLQPLKPSPSSDNLYSAFTSDGAISV

SEQ ID NO: 541 - protein, 44 aa, Homo sapiens
PSLSAPGQGTSSTNTVGATVNSQAAQAQPPAMTSSRKGTFTDDL

SEQ ID NO: 542 - protein, 46 aa, Homo sapiens
HKLVDNWARDAMNLSGRRGSKGHMNYEGPGMARKFSAPGQLCISMT

SEQ ID NO: 543 - protein, 46 aa, Homo sapiens
SNLGGSAPISAASATSLGHFTKSMCPPQQYGFPATPFGAQWSGTGG

SEQ ID NO: 544 - protein, 40 aa, Homo sapiens
PAPQPLGQFQPVGTASLQNFNISNLQKSISNPPGSNLRTT

SEQ ID NO: 545 - protein, 57 aa, Homo sapiens
  SITE (10): Xaa equals any of the naturally occurring L-amino acids
  SITE (17): Xaa equals any of the naturally occurring L-amino acids
VRVAAAESMXLLLECAXVRGPEYLTQMWHFMCDALIKAIGTEPDSDVLSEIMHSFAK

SEQ ID NO: 546 - protein, 85 aa, Homo sapiens [sequence omitted]

SEQ ID NO: 547 - protein, 100 aa, Homo sapiens
  SITE (8): Xaa equals any of the naturally occurring L-amino acids
  SITE (34): Xaa equals any of the naturally occurring L-amino acids
  SITE (38): Xaa equals any of the naturally occurring L-amino acids
GGREANKXFFIESCIALFVSFIINVFVVSVFAEXFFGXTNEQVVEVCTNTSSPHAGLFPKDNSTLAVDIYKGGVVLGCYFGPAALYIWAVGILAAGQSST

SEQ ID NO: 548 - protein, 45 aa, Homo sapiens
  SITE (8): Xaa equals any of the naturally occurring L-amino acids
  SITE (34): Xaa equals any of the naturally occurring L-amino acids
  SITE (38): Xaa equals any of the naturally occurring L-amino acids
GGREANKXFFIESCIALFVSFIINVFVVSVFAEXFFGXTNEQVVE

SEQ ID NO: 549 - protein, 55 aa, Homo sapiens
VCTNTSSPHAGLFPKDNSTLAVDIYKGGVVLGCYFGPAALYIWAVGILAAGQSST

SEQ ID NO: 550 - protein, 20 aa, Homo sapiens
QDKHAEEVRKNKELKEEASR

SEQ ID NO: 551 - protein, 92 aa, Homo sapiens
  SITE (16): Xaa equals any of the naturally occurring L-amino acids
  SITE (17): Xaa equals any of the naturally occurring L-amino acids
  SITE (20): Xaa equals any of the naturally occurring L-amino acids
  SITE (24): Xaa equals any of the naturally occurring L-amino acids
  SITE (36): Xaa equals any of the naturally occurring L-amino acids
  SITE (43): Xaa equals any of the naturally occurring L-amino acids
QQDLSPWAAPVGCPLXXASXTCHXLPLSGCLRRQSXSLPVVAXLCFWFSCPLASLFVPGQPCVTCPFPSLPFQDKHAEEVRKNKELKEEASR

SEQ ID NO: 552 - protein, 37 aa, Homo sapiens
  SITE (31): Xaa equals any of the naturally occurring L-amino acids
PTRCCTTQPCRSSARRPCWVPMVPSPEGREXQPTCPS

SEQ ID NO: 553 - protein, 363 aa, Homo sapiens
  SITE (68): Xaa equals any of the naturally occurring L-amino acids
  SITE (124): Xaa equals any of the naturally occurring L-amino acids
  SITE (211): Xaa equals any of the naturally occurring L-amino acids
MKRSLNENSARSTAGCLPVPLFNQKKRNRQPLTSNPLKDDSGISTPSDNYDFPPLPTDWAWEAVNPEXAPVMKTVDTGQIPHSVSRPLRSQDSVFNSIQSNTGRSQGGWSYRDGNKNTSLKTWXKNDFKPQCKRTNLVANDGKNSCPMSSGAQQQKQLRTPEPPNLSRNKETELLRQTHSSKISGCTMRGLDKNSALQTLKPNFQQNQYKXQMLDDIPEDNTLKETSLYQLQFKEKASSLRIISAVIESMKYWREHAQKTVLLFEVLAVLDSAVTPGPYYSKTFLMRDGKNTLPCVFYEIDRELPRLIRGRVHRCVGNYDQKKNIFQCVSVRPASVSEQKTFQAFVKIADVEMQYYINVMNET

SEQ ID NO: 554 - protein, 45 aa, Homo sapiens
  SITE (35): Xaa equals any of the naturally occurring L-amino acids
SQDSVFNSIQSNTGRSQGGWSYRDGNKNTSLKTWXKNDFKPQCKR

SEQ ID NO: 555 - protein, 36 aa, Homo sapiens
NKETELLRQTHSSKISGCTMRGLDKNSALQTLKPNF

SEQ ID NO: 556 - protein, 49 aa, Homo sapiens
SSLRIISAVIESMKYWREHAQKTVLLFEVLAVLDSAVTPGPYYSKTFLM

SEQ ID NO: 557 - protein, 42 aa, Homo sapiens
PRLIRGRVHRCVGNYDQKKNIFQCVSVRPASVSEQKTFQAFV

SEQ ID NO: 558 - protein, 370 aa, Homo sapiens
  SITE (320): Xaa equals any of the naturally occurring L-amino acids
  SITE (334): Xaa equals any of the naturally occurring L-amino acids
  SITE (337): Xaa equals any of the naturally occurring L-amino acids
  SITE (339): Xaa equals any of the naturally occurring L-amino acids
  SITE (341): Xaa equals any of the naturally occurring L-amino acids
  SITE (345): Xaa equals any of the naturally occurring L-amino acids
  SITE (350): Xaa equals any of the naturally occurring L-amino acids
  SITE (352): Xaa equals any of the naturally occurring L-amino acids
  SITE (355): Xaa equals any of the naturally occurring L-amino acids
  SITE (360): Xaa equals any of the naturally occurring L-amino acids
GVFRPCVCGRPASLTCSPLDPEVGPYCDTPTMRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKXKWRTKSSWGSTSMXWTXRXPXDARXPVVGXRXIQXLKDHXPRMVLDSKPQ

SEQ ID NO: 559 - protein, 39 aa, Homo sapiens
TCSPLDPEVGPYCDTPTMRTLFNLLWLALACSPVHTTLS

SEQ ID NO: 560 - protein, 54 aa, Homo sapiens
LVVTDLKAESVVLEHRSYCSAKARDRHFAGDVLGYVTPWNSHGYDVTKVFGSKF

SEQ ID NO: 561 - protein, 52 aa, Homo sapiens
REMFEVTGLHDVDQGWMRAVRKHAKGLHIVPRLLFEDWTYDDFRNVLDSEDE

SEQ ID NO: 562 - protein, 56 aa, Homo sapiens
HFDGFVVEVWNQLLSQKRVGLIHMLTHLAEALHQARLLALLVIPPAITPGTDQLGM

SEQ ID NO: 563 - protein, 47 aa, Homo sapiens
  SITE (36): Xaa equals any of the naturally occurring L-amino acids
DGFSLMTYDYSTAHQPGPNAPLSWVRACVQVLDPKXKWRTKSSWGST

SEQ ID NO: 564 - protein, 152 aa, Homo sapiens
ERGVSINQFCKEFNERTKDIKEGIPLPTKILVKPDRTFEIKIGQPTVSYFLKAAAGIEKGARQTGKEVAGLVTLKHVYEIARIKAQDEAFALQDVPLSSVVRSIIGSARSLGIRVVKDLSSEELAAFQKERAIFLAAQKEADLAAQEEAAKK

SEQ ID NO: 565 - protein, 51 aa, Homo sapiens
ERGVSINQFCKEFNERTKDIKEGIPLPTKILVKPDRTFEIKIGQPTVSYFL

SEQ ID NO: 566 - protein, 49 aa, Homo sapiens
KAAAGIEKGARQTGKEVAGLVTLKHVYEIARIKAQDEAFALQDVPLSSV

SEQ ID NO: 567 - protein, 52 aa, Homo sapiens
VRSIIGSARSLGIRVVKDLSSEELAAFQKERAIFLAAQKEADLAAQEEAAKK

SEQ ID NO: 568 - protein, 270 aa, Homo sapiens
AVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPSRTVTCPMSGKPLRMSDLTPVHFTPLDSSVDRVGLITRSERYVCAVTRDSLSNATPCAVLRPSGAVVTLECVEKLIRKDMVDPVTGDKLTDRDIIVLQRGGT

SEQ ID NO: 569 - protein, 54 aa, Homo sapiens
YLYEREAILEYILHQKKEIARQMKAYEKQRGTRREEQKELQRAASQDHVRGFLE

SEQ ID NO: 570 - protein, 64 aa, Homo sapiens
FTAKALSGTSPDDVQPGPSVGPPSKDKDKVLPSFWIPSLTPEAKATKLEKPSRTVTCPMSGKPL

SEQ ID NO: 571 - protein, 56 aa, Homo sapiens
VHFTPLDSSVDRVGLITRSERYVCAVTRDSLSNATPCAVLRPSGAVVTLECVEKLI

SEQ ID NO: 572 - protein, 66 aa, Homo sapiens
MSDLTPVHFTPLDSSVDRVGLITRSERYVCAVTRDSLSNATPCAVLRPSGAVVTLECVEKLIRKDM

SEQ ID NO: 573 - protein, 567 aa, Homo sapiens
  SITE (409): Xaa equals any of the naturally occurring L-amino acids
MDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRXRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGR

SEQ ID NO: 574 - protein, 48 aa, Homo sapiens
ENDVPEPPMPIADQVSNDDRPEGSVEDEEKKESSLPKSFKRKISVVSA

SEQ ID NO: 575 - protein, 37 aa, Homo sapiens
VDLHADDSRISEDETERNGDDGTHDKGLKICRTVTQV

SEQ ID NO: 576 - protein, 55 aa, Homo sapiens
PQVSVEVALPPPAEHEVKKVTLGDTLTRRSISQQKSGVSITIDDPVRTAQVPSPP

SEQ ID NO: 577 - protein, 55 aa, Homo sapiens
LKELLGRTGTLVEEAFWIDKIKSHCFVTYSTVEEAVATRTALHGVKWPQSNPKFL

SEQ ID NO: 578 - protein, 53 aa, Homo sapiens
VDRPSETKTEEQGIPRPLHPPPPPPVQPPQHPRAEQREQERAVREQWAERERE

SEQ ID NO: 579 - protein, 59 aa, Homo sapiens
  SITE (19): Xaa equals any of the naturally occurring L-amino acids
EWDRDKVREGPRSRSRSRXRRRKERAKSKEKKSEKKEKAQEEPPAKLLDDLFRKTKAAP

SEQ ID NO: 580 - protein, 64 aa, Homo sapiens
PLTDSQIVQKEAERAERAKEREKRRKEQEEEEQKEREKEAERERNRQLEREKRREHSRERDRER

SEQ ID NO: 581 - protein, 32 aa, Homo sapiens
LDVPLASRSPEFPLPLMTQSELPRCPPHPGAR

SEQ ID NO: 582 - protein, 15 aa, Homo sapiens
LATLSISPIWSVLSL

SEQ ID NO: 583 - protein, 51 aa, Homo sapiens
GCDSCPPHLPREAFAQDTQAEGECSSRAERADMCPDAPPSQEVPEGPGAAP

SEQ ID NO: 584 - protein, 91 aa, Homo sapiens
RGWLPSSCLSCALRVCPDSSSTQAMGMLLAFWLPGASWQEAARGQYSEDEDTDTDEYKEAKASINPVTGRVEEKPPNPMEGMTEEQKEHEA

SEQ ID NO: 585 - protein, 27 aa, Homo sapiens
TQAMGMLLAFWLPGASWQEAARGQYSE

SEQ ID NO: 586 - protein, 50 aa, Homo sapiens
PQLPSCGRPWPGTASVFQSHTQGPREDPDPCRAQGSAGTHCPISLSPPRQ

SEQ ID NO: 587 - protein, 103 aa, Homo sapiens
  SITE (23): Xaa equals any of the naturally occurring L-amino acids
  SITE (35): Xaa equals any of the naturally occurring L-amino acids
KTHPRALWSAGPSCALCPGGSGXTSPPQGAPRGIXWDRCPQIQVLEGQRVRFPSQPQHPSHLAPRGGCGWRPDSRPLLPTPSGLSSFFPLDAQCWPWRTVSWR

SEQ ID NO: 588 - protein, 200 aa, Homo sapiens
  SITE (25): Xaa equals any of the naturally occurring L-amino acids
  SITE (40): Xaa equals any of the naturally occurring L-amino acids
  SITE (42): Xaa equals any of the naturally occurring L-amino acids
  SITE (174): Xaa equals any of the naturally occurring L-amino acids
  SITE (186): Xaa equals any of the naturally occurring L-amino acids
AGAPGQQARLQYLLSFQGEGAPHEXGATGEGGDGAWEACXCXRCLLNWQAGGWGLQLSLMWLHRGPLRPPGVRWTPWAFLEACSWGPALSLLGSGHSLPGTHEQAAWSRGCGQHGQSPTQKCKSSKEPLAQAPPWDSPAAPPHQGFADVLERPTLEPFGVLAPPVPSALVEAAXQVLLREPQGGFXGTAAHRSRCWKGSG

SEQ ID NO: 589 - protein, 145 aa, Homo sapiens
  SITE (44): Xaa equals any of the naturally occurring L-amino acids
  SITE (81): Xaa equals any of the naturally occurring L-amino acids
  SITE (125): Xaa equals any of the naturally occurring L-amino acids
  SITE (142): Xaa equals any of the naturally occurring L-amino acids
MQLLFLLPHPSPQLHASLPHSAALPCPRGESLTTASPAGAAGRXDAVPRCRHQAGRGWVPRGPCERGGGDRGKPRAVAWDXGSLRWAVWSARAGQGRSSEPAPLASRRGYSTCCLSRGKGLPMRXGRRGRGVMVPGKPACAXGAC

SEQ ID NO: 590 - protein, 34 aa, Homo sapiens
QHPSHLAPRGGCGWRPDSRPLLPTPSGLSSFFPL

SEQ ID NO: 591 - protein, 30 aa, Homo sapiens
GVRWTPWAFLEACSWGPALSLLGSGHSLPG

SEQ ID NO: 592 - protein, 28 aa, Homo sapiens
WDSPAAPPHQGFADVLERPTLEPFGVLA

SEQ ID NO: 593 - protein, 28 aa, Homo sapiens
RSSEPAPLASRRGYSTCCLSRGKGLPMR

SEQ ID NO: 594 - protein, 42 aa, Homo sapiens
PGFRGPSGSLGCSFFPRSLGRVLPPGCQRPGAHADSSPPPTP

SEQ ID NO: 595 - protein, 84 aa, Homo sapiens
EDLKKPDPASLRAASCGEGKKRKACKNCTCGLAEELEKEKSREQMSSQPKSACGNCYLGDAFRCASCPYLGMPAFKPGEKVLLS

SEQ ID NO: 596 - protein, 90 aa, Homo sapiens
EDLKKPDPASLRAASCGEGKKRKACKNCTCGLAEELEKEKSREQMSSQPKSACGNCYLGDAFRCASCPYLGMPAFKPGEKVLLSDSNLHD

SEQ ID NO: 597 - protein, 34 aa, Homo sapiens
CGNCYLGDAFRCASCPYLGMPAFKPGEKVLLSDS

SEQ ID NO: 598 - protein, 25 aa, Homo sapiens
SCGEGKKRKACKNCTCGLAEELEKE

SEQ ID NO: 599 - protein, 21 aa, Homo sapiens
SQPKSACGNCYLGDAFRCASC

SEQ ID NO: 600 - protein, 17 aa, Homo sapiens
REAGQNSERQYVSLSRD

SEQ ID NO: 601 - protein, 16 aa, Homo sapiens
CCCVSKDQGIMGPGFR

SEQ ID NO: 602 - protein, 103 aa, Homo sapiens
HSVTELQTPALSLISAMLPPSCLSELLVYSILCDTSQVAHNLLRAPEDSLTGCCDDIQCPSAPFHPQPHLTVALHLCPVVIYVNLQVLNLLHILTYLEILHVL

SEQ ID NO: 603 - protein, 24 aa, Homo sapiens
LLVYSILCDTSQVAHNLLRAPEDS

SEQ ID NO: 604 - protein, 26 aa, Homo sapiens
LTVALHLCPVVIYVNLQVLNLLHILT

SEQ ID NO: 605 - protein, 55 aa, Homo sapiens
FFNALYVFRKPQAIFDSEKENKRKNPTKYNNPLRYIYFKVKLIFQFIPLANYKIK

SEQ ID NO: 606 - protein, 90 aa, Homo sapiens
ESSGQARTLADPGPGWPRQQGMCFGSLTGLSTTPHGFLTVSAEADPRLIESLSQMLSMGFSDEGGWLTRLLQTKNYDIGAALDTIQYSKH

SEQ ID NO: 607 - protein, 100 aa, Homo sapiens
YSMVYIYHIFFIHSLLDGQLGWFHIFAIVSCAAPDIIFNSFAFSTYISKSCSFYLQNVSCIHSSLSIFNLFQCPIISCMEECNNWLTGLFLHFKIKRCDR

SEQ ID NO: 608 - protein, 67 aa, Homo sapiens
LSPSPRCCPWASLMKAAGSPGSCRPRTMTSERLWTPSSIQSIPRRCDHFCPPLLRAPLLSHSCVKLA

SEQ ID NO: 609 - protein, 34 aa, Homo sapiens
GWPRQQGMCFGSLTGLSTTPHGFLTVSAEADPRL

SEQ ID NO: 610 - protein, 33 aa, Homo sapiens
LGWFHIFAIVSCAAPDIIFNSFAFSTYISKSCS

SEQ ID NO: 611 - protein, 25 aa, Homo sapiens
SLSIFNLFQCPIISCMEECNNWLTG

SEQ ID NO: 612 - protein, 30 aa, Homo sapiens
LMKAAGSPGSCRPRTMTSERLWTPSSIQSI

SEQ ID NO: 613 - protein, 152 aa, Homo sapiens
  SITE (35): Xaa equals any of the naturally occurring L-amino acids
  SITE (71): Xaa equals any of the naturally occurring L-amino acids
SSSSPRRPRELLGSLKTPLVRPHSAPLDLPGSFCXHTADPMGALHTRFWGRQTWIHRKLRLHGTSRLASKXGIQFLRNPSKTHTPRDAAFRDPGQTPDPQSLQAPSPSKCSAPNRATSVWSLKPRLLYKHRPSSDKTPPPGRQAPLLFFSAG

SEQ ID NO: 614 - protein, 30 aa, Homo sapiens
FLRNPSKTHTPRDAAFRDPGQTPDPQSLQA

SEQ ID NO: 615 - protein, 159 aa, Homo sapiens
  SITE (43): Xaa equals any of the naturally occurring L-amino acids
  SITE (155): Xaa equals any of the naturally occurring L-amino acids
QEGSEPVLLEGECLVVCEPGRAAAGGPGGAALGEAPPGRVAFXAVRSHHHEPAGETGNGTSGAIYFDQVLVNEGGGFDRASGSFVAPVRGVYSFRFHVVKVYNRQTVQVSLMLNTWPVISAFANDPDVTREAATSSVLLPLDPGDRVSLRLRRGXSTGW

SEQ ID NO: 616 - protein, 35 aa, Homo sapiens
GETGNGTSGAIYFDQVLVNEGGGFDRASGSFVAPV

SEQ ID NO: 617 - protein, 25 aa, Homo sapiens
NDPDVTREAATSSVLLPLDPGDRVS

SEQ ID NO: 618 - protein, 11 aa, Homo sapiens
FHVVKVYNRQT

SEQ ID NO: 619 - protein, 9 aa, Homo sapiens
IYFDQVLVN

SEQ ID NO: 620 - protein, 25 aa, Homo sapiens
ESRERSGNRRGAEDRGTCGLQSPSA

SEQ ID NO: 621 - protein, 70 aa, Homo sapiens
  SITE (30): Xaa equals any of the naturally occurring L-amino acids
  SITE (31): Xaa equals any of the naturally occurring L-amino acids
  SITE (34): Xaa equals any of the naturally occurring L-amino acids
  SITE (37): Xaa equals any of the naturally occurring L-amino acids
EMPQFYFFLKLGCLAQVPMQRGGIGARGSXXPAXAVXGAREGRRKLSGAGFLCLKDLGPSEREDEEARET

SEQ ID NO: 622 - protein, 27 aa, Homo sapiens
MPQFYFFLKLGCLAQVPMQRGGIGARG

SEQ ID NO: 623 - protein, 185 aa, Homo sapiens
QATCSASGSPGQFGGCTPSPHGTGSCRHPGQGLRRSQRPGQSHRPRSPGPGRSRWPHWCHCRFPLLAHGGGFGPQQMPLAQGVPLPGLLPRAPLQQLGQAHRPPGTPPPAGRALTPPGPTRPPGPEAPEPRAARDCVGDLVASVAWLPTWLRGSATHKCPGLLPLFCFRSSPWILTAGTLIVCPL

SEQ ID NO: 624 - protein, 25 aa, Homo sapiens
GCTPSPHGTGSCRHPGQGLRRSQRP

SEQ ID NO: 625 - protein, 26 aa, Homo sapiens
SRWPHWCHCRFPLLAHGGGFGPQQMP

SEQ ID NO: 626 - protein, 28 aa, Homo sapiens
DCVGDLVASVAWLPTWLRGSATHKCPGL

SEQ ID NO: 627 - protein, 115 aa, Homo sapiens
  SITE (77): Xaa equals any of the naturally occurring L-amino acids
DDRPRVQHQAHLDSLAVVHLHHMEPEAVDTPDRGYEGARGPVKATALVHQDLVEVDGPTGAIAGFPCWLMVVASDRXKCHSPRGCLSQGCSPGPPCSSSARLTDHQALPLQQDGL

SEQ ID NO: 628 - protein, 31 aa, Homo sapiens
YEGARGPVKATALVHQDLVEVDGPTGAIAGF

SEQ ID NO: 629 - protein, 159 aa, Homo sapiens
  SITE (22): Xaa equals any of the naturally occurring L-amino acids
MAPLVPLPVSPAGSWWWLRTAXNATRPGGASPRAAPPGPPAAARPGSQTTRHSPSSRTGSDPSWAHPAPRARSTRTKGSPGLCRGPGSQCGLAPNMAEGLCNPQVPRSSAPLLFPLLSLDSHRRHPDSLPSLGSLNPLSIPVSQLCPASHSYSCCHCSS

SEQ ID NO: 630 - protein, 29 aa, Homo sapiens
SSRTGSDPSWAHPAPRARSTRTKGSPGLC

SEQ ID NO: 631 - protein, 27 aa, Homo sapiens
RRHPDSLPSLGSLNPLSIPVSQLCPAS

SEQ ID NO: 632 - protein, 31 aa, Homo sapiens
STHASGPPAPERLCLPERGTAPWGRRANDAA

SEQ ID NO: 633 - protein, 181 aa, Homo sapiens
  SITE (56): Xaa equals any of the naturally occurring L-amino acids
  SITE (57): Xaa equals any of the naturally occurring L-amino acids
  SITE (60): Xaa equals any of the naturally occurring L-amino acids
  SITE (83): Xaa equals any of the naturally occurring L-amino acids
  SITE (84): Xaa equals any of the naturally occurring L-amino acids
  SITE (165): Xaa equals any of the naturally occurring L-amino acids
VRRWWLRTMGAAAHCTPEQRRPRRPATILGMDTQNILHTRLSLCSLSWVSLASSFXXLAXRRKAIVVQQKQSKISKKKKVEKXXLNDSVNENSDTVGQIVHYIMKNEANADVLKAMVADNSLYDPESPVTPSTPGSPPVSPGLCHQGGRQGSTSVAIICIRWAVXSRGMCVIGVGTSGGTL

SEQ ID NO: 634 - protein, 29 aa, Homo sapiens
IMKNEANADVLKAMVADNSLYDPESPVTP

SEQ ID NO: 635 - protein, 143 aa, Homo sapiens
  SITE (77): Xaa equals any of the naturally occurring L-amino acids
HCHLWASGSCLACFFPGGLTRDAAQQHVTKSYSPPYLSQTSHSCLVFQPVLWPEYTFWNLFEAILQFQMNHSVLQQXGPRHVCRGAEEAAAGEGPGYSDRAAAARGAPSQWGRPAPKDTLAQTLGQTGRASPRLPAGLGTQAS

SEQ ID NO: 636 - protein, 28 aa, Homo sapiens
PAPKDTLAQTLGQTGRASPRLPAGLGTQ

SEQ ID NO: 637 - protein, 85 aa, Homo sapiens
  SITE (7): Xaa equals any of the naturally occurring L-amino acids
TIACFSXKARDMYAEERKRQQLERDQATVTEQLLREGLQASGDAQLRRTRLHKLSARREERVQGFLQALELKRADWLARLGTASA

SEQ ID NO: 638 - protein, 28 aa, Homo sapiens
LRRTRLHKLSARREERVQGFLQALELKR

SEQ ID NO: 639 - protein, 112 aa, Homo sapiens
  SITE (15): Xaa equals any of the naturally occurring L-amino acids
KMNSIPWQIPKITPXLDANLVIVECKPLWFCIGTIKQLKLWNQVFMGFKSMFFRIGKLNYLFTIPYCYLFIDNILGIFYSILGAQGIKYNFYIQRIFTCLLNLNLKIHSNLA

SEQ ID NO: 640 - protein, 27 aa, Homo sapiens
LWFCIGTIKQLKLWNQVFMGFKSMFFR

SEQ ID NO: 641 - protein, 26 aa, Homo sapiens
YSILGAQGIKYNFYIQRIFTCLLNLN

SEQ ID NO: 642 - protein, 9 aa, Homo sapiens
TFKLVRFLE

SEQ ID NO: 643 - protein, 32 aa, Homo sapiens
PRSRPALRPGRQRPPSHSATSGVLRPRKKPDP

SEQ ID NO: 644 - protein, 120 aa, Homo sapiens
  SITE (105): Xaa equals any of the naturally occurring L-amino acids
  SITE (115): Xaa equals any of the naturally occurring L-amino acids
RKSFAKPVLWTNAIQAGRGRVLCYTRPPPASSSFSALVPDGNRMEGLRTYFLNAFDPGTDYLYLFPFSFTVTFQHCLTVRWAFESLQVPQNRPERWASHPLPTHXPAYLPDNQVXMSASG

SEQ ID NO: 645 - protein, 25 aa, Homo sapiens
GNRMEGLRTYFLNAFDPGTDYLYLF

SEQ ID NO: 646 - protein, 30 aa, Homo sapiens
FQHCLTVRWAFESLQVPQNRPERWASHPLP

SEQ ID NO: 647 - protein, 31 aa, Homo sapiens
  SITE (8): Xaa equals any of the naturally occurring L-amino acids
  SITE (13): Xaa equals any of the naturally occurring L-amino acids
MTLITPSXKLTFXKGNKSWSSRACSSTLVDP

SEQ ID NO: 648 - protein, 14 aa, Homo sapiens
FLFLHAVDPWPSNG

SEQ ID NO: 649 - protein, 61 aa, Homo sapiens
WSCQSGVFLVFTGCSVLCQMLSGAVVVWRRSAPEDSAVWQASINKPRGKGRHGIKGENTSV

SEQ ID NO: 650 - protein, 35 aa, Homo sapiens
LVFTGCSVLCQMLSGAVVVWRRSAPEDSAVWQASI

SEQ ID NO: 651 - protein, 51 aa, Homo sapiens
GHPSPALSIAPSDGSQLPCDEVPYGEAHVTRYCKKPLTNSHLETEAQSSSL

SEQ ID NO: 652 - protein, 151 aa, Homo sapiens
  SITE (131): Xaa equals any of the naturally occurring L-amino acids
  SITE (145): Xaa equals any of the naturally occurring L-amino acids
NNKHYLSFCGSGFCPVYLGFTGLASHQAVKVLVVAVIIPRQDRERICLQAQVGRIHLRGCWTGPPFLDGYWSEAFYNTLSRGPLHRAPHHMATGFHQREQWKEQEKGDQGRHRSLLVASPQKRCYFCCILXVRSESLGPGVEFYXGVNGRR

SEQ ID NO: 653 - protein, 32 aa, Homo sapiens
ERICLQAQVGRIHLRGCWTGPPFLDGYWSEAF

SEQ ID NO: 654 - protein, 26 aa, Homo sapiens
SDGSQLPCDEVPYGEAHVTRYCKKPL

SEQ ID NO: 655 - protein, 27 aa, Homo sapiens
HQREQWKEQEKGDQGRHRSLLVASPQK

SEQ ID NO: 656 - DNA, 263 bp, Homo sapiens
gcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaa

SEQ ID NO: 657 - DNA, 263 bp, Homo sapiens; identical to SEQ ID NO: 656

SEQ ID NO: 658 - DNA, 263 bp, Homo sapiens; identical to SEQ ID NO: 656

SEQ ID NO: 659 - protein, 56 aa, Homo sapiens
  SITE (10): Xaa equals any of the naturally occurring L-amino acids
FRINRLTIGXAVAMTRGNQRELARQKNMKKQSDSVKGKRRDDGLSAAARKQRDSEI

SEQ ID NO: 660 - protein, 29 aa, Homo sapiens
AVAMTRGNQRELARQKNMKKQSDSVKGKR

SEQ ID NO: 661 - protein, 110 aa, Homo sapiens
KSRATRLRESAEMTGFLLPPASRGTRRSCSRSRKRQTRRRRNPSSFVASCPTLLPFACVPGASPTTLAFPPVVLTGPSTDGIPFALSLQRVPFVLPSPQVASLPLGHSRG

SEQ ID NO: 662 - protein, 26 aa, Homo sapiens
LRESAEMTGFLLPPASRGTRRSCSRS

SEQ ID NO: 663 - protein, 30 aa, Homo sapiens
VVLTGPSTDGIPFALSLQRVPFVLPSPQVA

SEQ ID NO: 664 - protein, 59 aa, Homo sapiens
LLSTSHLLTQSYSFNKRSHSFAWKNAHCILQSENNELQNSVYIYVCIYVHFICTFLCDI

SEQ ID NO: 665 - protein, 32 aa, Homo sapiens
KRSHSFAWKNAHCILQSENNELQNSVYIYVCI

SEQ ID NO: 666 - DNA, 160 bp, Homo sapiens
tggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaa

SEQ ID NO: 667 - protein, 292 aa, Homo sapiens
  SITE (105): Xaa equals any of the naturally occurring L-amino acids
LDELMAHLTEMQAKVAVRADAGKKHLPDKQDHKASLDSMLGGLEQELQDLGIATVPKGHCASCQKPIAGKVIHALGQSWHPEHFVCTHCKEEIGSSPFFERSGLXYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLF

SEQ ID NO: 668 - protein, 43 aa, Homo sapiens
KASLDSMLGGLEQELQDLGIATVPKGHCASCQKPIAGKVIHAL

SEQ ID NO: 669 - protein, 50 aa, Homo sapiens
CPNDYHQLFSPRCAYCAAPILDKVLTAMNQTWHPEHFFCSHCGEVFGAEG

SEQ ID NO: 670 - protein, 67 aa, Homo sapiens
DKKPYCRKDFLAMFSPKCGGCNRPVLENYLSAMDTVWHPECFVCGDCFTSFSTGSFFELDGRPFCEL

SEQ ID NO: 671 - protein, 46 aa, Homo sapiens
CGQPITGRCISAMGYKFHPEHFVCAFCLTQLSKGIFREQNDKTYCQ

SEQ ID NO: 672 - protein, 334 aa, Homo sapiens
  SITE (8): Xaa equals any of the naturally occurring L-amino acids
  SITE (145): Xaa equals any of the naturally occurring L-amino acids
HKSLAGAXVYTTNIQELNVYSEAQEPKESPPPSKTSAAAQLDELMAHLTEMQAKVAVRADAGKKHLPDKQDHKASLDSMLGGLEQELQDLGIATVPKGHCASCQKPIAGKVIHALGQSWHPEHFVCTHCKEEIGSSPFFERSGLXYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 673 - protein, 22 aa, Homo sapiens
NVYSEAQEPKESPPPSKTSAAA

SEQ ID NO: 674 - protein, 26 aa, Homo sapiens
DSMLGGLEQELQDLGIATVPKGHCAS

SEQ ID NO: 675 - protein, 26 aa, Homo sapiens
YLSAMDTVWHPECFVCGDCFTSFSTG

SEQ ID NO: 676 - protein, 26 aa, Homo sapiens
RCISAMGYKFHPEHFVCAFCLTQLSK

SEQ ID NO: 677 - protein, 127 aa, Homo sapiens
  SITE (87): Xaa equals any of the naturally occurring L-amino acids
PTRPVLFFSTCQSCSSRPVRQEHLGCRTMEELDALLEELERSTLQDSDEYSNPAPLPLDQHSRKETNLDETSEILSIQDNTSPLPAXSCILPISRSSMSTVKPKSQRNHHHLLKRQQLLSWMSSWLT

SEQ ID NO: 678 - protein, 28 aa, Homo sapiens
PVRQEHLGCRTMEELDALLEELERSTLQ

SEQ ID NO: 679 - protein, 21 aa, Homo sapiens
SCILPISRSSMSTVKPKSQRN

SEQ ID NO: 680 - protein, 11 aa, Homo sapiens
WHPEHFVCTHC

SEQ ID NO: 681 - protein, 6 aa, Homo sapiens
LFSPRC

SEQ ID NO: 682 - protein, 6 aa, Homo sapiens
PILDKV

SEQ ID NO: 683 - protein, 8 aa, Homo sapiens
TWHPEHFF

SEQ ID NO: 684 - protein, 7 aa, Homo sapiens
EGFHEKD

SEQ ID NO: 685 - protein, 13 aa, Homo sapiens
KFHPEHFVCAFCL

SEQ ID NO: 686 - protein, 7 aa, Homo sapiens
PITGRCI

SEQ ID NO: 687 - protein, 7 aa, Homo sapiens
HPEHFVC

SEQ ID NO: 688 - protein, 31 aa, Homo sapiens
  SITE (12): Xaa equals any of the naturally occurring L-amino acids
RIYCSEDTFSPXAESGVSWQSSVSQLYQDYE

SEQ ID NO: 689 - protein, 452 aa, Homo sapiens
  SITE (61): Xaa equals any of the naturally occurring L-amino acids
MGSSQSVEIPGGGTEGYHVLRVQENSPGHRAGLEPFFDFIVSINGSRLNKDNDTLKDLLKXNVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSDPATTTAKADAASSLTVDVTPPTAKAPTTVEDRVGDSTPVSEKPVSAAVDANASESP

SEQ ID NO: 690 - protein, 109 aa, Homo sapiens
  SITE (56): Xaa equals any of the naturally occurring L-amino acids
SVEIPGGGTEGYHVLRVQENSPGHRAGLEPFFDFIVSINGSRLNKDNDTLKDLLKXNVEKPVKMLIYSSKTLELRETSVTPSNLWGGQGLLGVSIRFCSFDGANENVWH

SEQ ID NO: 691 - protein, 145 aa, Homo sapiens
ESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISS

SEQ ID NO: 692 - protein, 145 aa, Homo sapiens; identical to SEQ ID NO: 691

SEQ ID NO: 693 - protein, 151 aa, Homo sapiens
RIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRN

SEQ ID NO: 694 - protein, 109 aa, Homo sapiens
PGLPPLPSMPPRNLPGIAPLPLPSEFLPSFPLVPESSSAASSGELLSSLPPTSNAPSDPATTTAKADAASSLTVDVTPPTAKAPTTVEDRVGDSTPVSEKPVSAAVDAN

SEQ ID NO: 695 - protein, 22 aa, Homo sapiens
AWGGEGSLGCGIGYGYLHRIPT

SEQ ID NO: 696 - protein, 10 aa, Homo sapiens
SPAALAGLRP

SEQ ID NO: 697 - protein, 8 aa, Homo sapiens
WGGQGLLG

SEQ ID NO: 698 - protein, 27 aa, Homo sapiens
RNGALLDKNFFNANSHFPVKGERIRRR

SEQ ID NO: 699 - protein, 97 aa, Homo sapiens
  SITE (83): Xaa equals any of the naturally occurring L-amino acids
RGSGFGWTSFPRPLPTELTCPGFHRERAFPPDGRVRGVRGWGIRRGCRAVWGVGACGCSPGSSWRGSAHRASGPADLPVACRXEGGADSPSLLPSPP

SEQ ID NO: 700 - protein, 23 aa, Homo sapiens
AVWGVGACGCSPGSSWRGSAHRA

SEQ ID NO: 701 - protein, 77 aa, Homo sapiens
YRPTMEKMKQVVTQTRWMRPDAKRANRRHRRISGKIFAWNPLPKTRFSRLLKAVSENTKRPEPSRPPWMVSHSVEAS

SEQ ID NO: 702 - protein, 27 aa, Homo sapiens
FAWNPLPKTRFSRLLKAVSENTKRPEP

SEQ ID NO: 703 - protein, 93 aa, Homo sapiens
  SITE (27): Xaa equals any of the naturally occurring L-amino acids
  SITE (28): Xaa equals any of the naturally occurring L-amino acids
  SITE (29): Xaa equals any of the naturally occurring L-amino acids
  SITE (30): Xaa equals any of the naturally occurring L-amino acids
  SITE (31): Xaa equals any of the naturally occurring L-amino acids
  SITE (32): Xaa equals any of the naturally occurring L-amino acids
  SITE (33): Xaa equals any of the naturally occurring L-amino acids
  SITE (34): Xaa equals any of the naturally occurring L-amino acids
  SITE (35): Xaa equals any of the naturally occurring L-amino acids
  SITE (36): Xaa equals any of the naturally occurring L-amino acids
  SITE (37): Xaa equals any of the naturally occurring L-amino acids
  SITE (38): Xaa equals any of the naturally occurring L-amino acids
IYKVFRHTAGLKPEVSCFENIRSCARXXXXXXXXXXXXWIFGVLHVVHASVVTAYLFTVSNAFQGMFIFLFLCVLSRKIQEEYYRLFKNVPCC

SEQ ID NO: 704 - protein, 55 aa, Homo sapiens
WIFGVLHVVHASVVTAYLFTVSNAFQGMFIFLFLCVLSRKIQEEYYRLFKNVPCC

SEQ ID NO: 705 - protein, 26 aa, Homo sapiens
IYKVFRHTAGLKPEVSCFENIRSCAR

SEQ ID NO: 706 - protein, 66 aa, Homo sapiens
IIYKVFRHTAGLKPEVSCFENIRSCARGALALLFLLGTTWIFGVLHVVHASVVTAYLFTVSNAFQG

SEQ ID NO: 707 - protein, 32 aa, Homo sapiens
EVSCFENIRSCARGALALLFLLGTTWIFGVLH

SEQ ID NO: 708 - protein, 86 aa, Homo sapiens
TTILRTCTIVCFYYWFNGVMVLLFFLDRNLLTFNQASIMPFSNTDFLHCLSFKKKLMLLRYIFYVVLTGPTLSLKGDENQIKNLFT

SEQ ID NO: 709 - protein, 23 aa, Homo sapiens
IVCFYYWFNGVMVLLFFLDRNLL

SEQ ID NO: 710 - protein, 24 aa, Homo sapiens
LLRYIFYVVLTGPTLSLKGDENQI

SEQ ID NO: 711 - protein, 50 aa, Homo sapiens
ALTRIPPGDWVINVTAVSFAGKTTARFFXHSSPPSLGDQARTDPGHQRRD

SEQ ID NO: 712 - protein, 38 aa, Homo sapiens
SMLLLFPLQERPQQDSFIRLLLAWGTRLELTLDIKGGI

SEQ ID NO: 713 - protein, 130 aa, Homo sapiens
  SITE (76): Xaa equals any of the naturally occurring L-amino acids
  SITE (80): Xaa equals any of the naturally occurring L-amino acids
  SITE (90): Xaa equals any of the naturally occurring L-amino acids
  SITE (98): Xaa equals any of the naturally occurring L-amino acids
  SITE (113): Xaa equals any of the naturally occurring L-amino acids
TGLWADGFSSHIIPPLMSRVSSSLVPQARRRRMKESCCGLSCKGNSSNIDYPVTGRNSCERAPLCAFALHFQERTXITGXGEDPGPFQSXGRVTASRXTLACSHVAMTPAGCXQALGTPSSYCVRKAPRA

SEQ ID NO: 714 - protein, 28 aa, Homo sapiens
QARRRRMKESCCGLSCKGNSSNIDYPVT

SEQ ID NO: 715 - protein, 9 aa, Homo sapiens
LWRSSGVER

SEQ ID NO: 716 - protein, 27 aa, Homo sapiens
LQEVNITLPENSVWYERYKFDIPVFHL

SEQ ID NO: 717 - protein, 110 aa, Homo sapiens
MQGSGSQFRACLLCLCFSCPCSPGGPRWNSRQGGRRFPKTCRAISQNLVFKYKTFCPVRYMQPHRSSLCLHFTSYVFILSTWGSLRTYSTDLKKKKKNSRGGPVPIRPKS

SEQ ID NO: 718 - DNA, 99 bp, Homo sapiens
  SITE (24): n equals a,t,g, or c
tagcatgtagccagtcgaataacntataaggacaaagtggagtccacgcgtgcggccgtctagactagtggatcccccggctgcaggattcggcacgag

SEQ ID NO: 719 - protein, 51 aa, Homo sapiens
MQGSGSQFRACLLCLCFSCPCSPGGPRWNSRQGGRRFPKTCRAISQNLVFK

SEQ ID NO: 720 - protein, 54 aa, Homo sapiens
PVRYMQPHRSSLCLHFTSYVFILSTWGSLRTYSTDLKKKKKNSRGGPVPIRPKS

SEQ ID NO: 721 - protein, 38 aa, Homo sapiens [sequence omitted]

SEQ ID NO: 722 - protein, 39 aa, Homo sapiens
TSGSPGCRIRHELPGEEQRDCSLGWRGVGMRATHCQAAR

SEQ ID NO: 723 - protein, 128 aa, Homo sapiens [sequence omitted]

SEQ ID NO: 724 - protein, 31 aa, Homo sapiens
QFRACLLCLCFSCPCSPGGPRWNSRQGGRRF

SEQ ID NO: 725 - protein, 23 aa, Homo sapiens
NQFTSCILFCDGGHWRELLFQSI

SEQ ID NO: 726 - protein, 101 aa, Homo sapiens
AMSSKLLNLLALLQYSVHDHCHPRRLLKRGARATLRHKGWGPSSLRGCESFQIVLIGWGPDLAVGFGRGKLLSRSLPVRHGGVSEFCLPHRDVVRLEKVKK

SEQ ID NO: 727 - protein, 33 aa, Homo sapiens
GPSSLRGCESFQIVLIGWGPDLAVGFGRGKLLS

SEQ ID NO: 728 - protein, 32 aa, Homo sapiens
  SITE (8): Xaa equals any of the naturally occurring L-amino acids
TRKNIDFXETEKYYLFSFSNNVSFKNFWLKYN

SEQ ID NO: 729 - protein, 161 aa, Homo sapiens
  SITE (46): Xaa equals any of the naturally occurring L-amino acids
  SITE (50): Xaa equals any of the naturally occurring L-amino acids
MPRKTSKCRQLLCSGASRNADTAARQSTCSSHRPPGKIPSLGPRRXPGCXSVPSSRGEQSTGSPAAPRCGRRDAHRGLPGGAAMTPGDTWASFNPRAGHSKSQGEGQESSGASRQDRHPVSHWVERQREAWGAPRSSSAGGVKVAATTEREPEFKIKTGKA

SEQ ID NO: 730 - protein, 88 aa, Homo sapiens
  SITE (34): Xaa equals any of the naturally occurring L-amino acids
  SITE (38): Xaa equals any of the naturally occurring L-amino acids
CSGASRNADTAARQSTCSSHRPPGKIPSLGPRRXPGCXSVPSSRGEQSTGSPAAPRCGRRDAHRGLPGGAAMTPGDTWASFNPRAGHS

SEQ ID NO: 731 - protein, 59 aa, Homo sapiens
QGEGQESSGASRQDRHPVSHWVERQREAWGAPRSSSAGGVKVAATTEREPEFKIKTGKA

SEQ ID NO: 732 - protein, 63 aa, Homo sapiens [sequence omitted]

SEQ ID NO: 733 - protein, 176 aa, Homo sapiens
  SITE (127): Xaa equals any of the naturally occurring L-amino acids
TRAESLFPLLHAFPVFILNSGSLSVVAATFTPPALLLLGAPQASLCLSTQWLTGCLSCLDAPLLSCPSPWLLLCPALGLKLAHVSPGVMAAPPGRPLCASRLPHLGAAGEPVLCSPRLLGTELQPGXLRGPRLGILPGGRWEEQVLCLAAVSAFLDAPEHRSCRHFEVFLGMCQIT

SEQ ID NO: 734 - protein, 29 aa, Homo sapiens
PALGLKLAHVSPGVMAAPPGRPLCASRLP

SEQ ID NO: 735 - protein, 24 aa, Homo sapiens
GGRWEEQVLCLAAVSAFLDAPEHR

SEQ ID NO: 736 - protein, 98 aa, Homo sapiens
  SITE (48): Xaa equals any of the naturally occurring L-amino acids
SWPMCPPESWLLLLGGLCVRHVFHTWGQLASPCSVPLGCLAQSCSLGXSVDPDWGFCQGGDGRSRCFAWRLCLHFWTPQSTEVAGTLRSSSACARLHE

SEQ ID NO: 737 - protein, 29 aa, Homo sapiens
GDGRSRCFAWRLCLHFWTPQSTEVAGTLR

SEQ ID NO: 738 - protein, 235 aa, Homo sapiens; identical to SEQ ID NO: 318

SEQ ID NO: 739 - protein, 114 aa, Homo sapiens
MSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNY

SEQ ID NO: 740 - protein, 81 aa, Homo sapiens
LNALGGPGMPGMNMGPGGGRPWPNPTNANSIPYSSASPGNYVGPPGGGGPPGTPIMPSPADSTNSGDNMYTLMNAVPPGPN

SEQ ID NO: 741 - protein, 70 aa, Homo sapiens
GPMGGLGGMESHHMNGSLGSGDMDSISKNSPNNMSLSNQPGTPRDDGEMGGNFLNPFQSESYSPSMTMSV

SEQ ID NO: 742 - protein, 14 aa, Homo sapiens
TCEHSSEAKAFHDY

SEQ ID NO: 743 - protein, 19 aa, Homo sapiens
RRETCEHSSEAKAFHDYPF

SEQ ID NO: 744 - protein, 20 aa, Homo sapiens
TITLFQSAWCFFSKYCTDFT

SEQ ID NO: 745 - protein, 105 aa, Homo sapiens
VRGCEDGGGGGIWGGWWPGQQMAPPWLSCPHRQFPHFHSGRQRRQSDLLKEELPQPSGAAGRASGNKPYTPPPASNSLTLRLLSFRFNAFNRSHPQPSLNYKDRQ

SEQ ID NO: 746 - protein, 25 aa, Homo sapiens
PWLSCPHRQFPHFHSGRQRRQSDLL

SEQ ID NO: 747 - protein, 20 aa, Homo sapiens
RLLSFRFNAFNRSHPQPSLN

SEQ ID NO: 748 - protein, 56 aa, Homo sapiens
RDSSLWAAALSFRQQCSSLASCLVSMYSRPGRQHRAKAGAGSQTEQCWGRKVDAVV

SEQ ID NO: 749 - protein, 27 aa, Homo sapiens
CLVSMYSRPGRQHRAKAGAGSQTEQCW

SEQ ID NO: 750 - protein, 86 aa, Homo sapiens
PEHGFSSCDFWEGAPSSGPKEGGRSPPQLACVWGMNLSSPPCLALLTNRACLAVNWHRVTLFPGIQVCNQNTGEEKLQDPCPHLSS

SEQ ID NO: 751 - protein, 30 aa, Homo sapiens
RSPPQLACVWGMNLSSPPCLALLTNRACLA

SEQ ID NO: 752 - protein, 74 aa, Homo sapiens
CERDSETSSIAMTCIKHKPPKQKKRLSLLPGFRSALPRVCRCHMITVQREAFRTHTGCSTSVHLPSRGGFLPDF

SEQ ID NO: 753 - protein, 28 aa, Homo sapiens
KKRLSLLPGFRSALPRVCRCHMITVQRE

SEQ ID NO: 754 - protein, 59 aa, Homo sapiens
QAFVLLSDLLLIFSPQMIVGGRDFLRPLVFFPEATLQSELASFLMDHVFIQPGDLGSGA

SEQ ID NO: 755 - protein, 43 aa, Homo sapiens
ACSYLLCNPEFTFFSRADFARSQLVDLLTDRFQQELEELLQVG

SEQ ID NO: 756 - protein, 35 aa, Homo sapiens
QKQLSSLRDRMVAFCELCQSCLSDVDTEIQEQVST

SEQ ID NO: 757 - protein, 27 aa, Homo sapiens
QVILPALTLVYFSILWTLTHISKSDAS

SEQ ID NO: 758 - protein, 31 aa, Homo sapiens
  SITE (26): Xaa equals any of the naturally occurring L-amino acids
STHDLTRWELYEPCCQLLQKAVDTGXVPHQV

SEQ ID NO: 759 - protein, 66 aa, Homo sapiens
TSFLFPLQAFVLLSDLLLIFSPQMIVGGRDFLRPLVFFPEATLQSELASFLMDHVFIQPGDLGSGA

SEQ ID NO: 760 - protein, 68 aa, Homo sapiens
GWGACSYLLCNPEFTFFSRADFARSQLVDLLTDRFQQELEELLQVGAGAGQWDTPNKGGRGCKTGDVD

SEQ ID NO: 761 - protein, 78 aa, Homo sapiens
VWVLDGIMGTEESVSSFFPFKPLCPQKQLSSLRDRMVAFCELCQSCLSDVDTEIQEQVSTDSSGSNKASIPAPIPRRN

SEQ ID NO: 762 - protein, 152 aa, Homo sapiens
  SITE (67): Xaa equals any of the naturally occurring L-amino acids
  SITE (86): Xaa equals any of the naturally occurring L-amino acids
NASLPSTSEWLSSSSPSRFYWCLWSWFPLFFSSITFPFLPQSTHDLTRWELYEPCCQLLQKAVDTGXVPHQVSGQARDGLGAGGLXFKDLRSRWPLGVSSLSAWSGQSEEDQVGGGHLLHSSLRRWTLLPGSSWISWKPRIILRDSRRRRVN

SEQ ID NO: 763 - protein, 38 aa, Homo sapiens
VLGEMLLWIFFPSQSSFLDEDEVYNLAATLKRLSAFYK

SEQ ID NO: 764 - protein, 44 aa, Homo sapiens
PKPHFSNPLLLQVILPALTLVYFSILWTLTHISKSDASPGECGS

SEQ ID NO: 765 - protein, 7 aa, Homo sapiens
HCQFLLG

SEQ ID NO: 766 - protein, 53 aa, Homo sapiens [sequence omitted]

SEQ ID NO: 767 - protein, 54 aa, Homo sapiens
  SITE (17): Xaa equals any of the naturally occurring L-amino acids
TKPGMVGHVPIVPATKXAEAGGSPEPGSSTLQWPMITPCTPSWATEPDHVSEDE

SEQ ID NO: 768 - protein, 30 aa, Homo sapiens
LLYHWETRAQPSLILYVVSDLRWMEFRTSC

SEQ ID NO: 769 - protein, 106 aa, Homo sapiens
  SITE (46): Xaa equals any of the naturally occurring L-amino acids
LAVSTSFICCADISTALPLGSSRPAPAPRHREHEHGHQARPPRLLXTSLMPLSTPAAAQLLWTQLTPMGGRPGGRHSPPTLHTGPRALPPGPPHPSLHVAALSLLR

SEQ ID NO: 770 - protein, 85 aa, Homo sapiens
  SITE (27): Xaa equals any of the naturally occurring L-amino acids
  SITE (38): Xaa equals any of the naturally occurring L-amino acids
APAVPHQPPGTESTSMGTKPGLPGCSXRPLCHYQHQLXPSYFGHSSPPWGAVLVGVTPHPRCTPAPGPCRLGLHTHPCTWQLCLC

SEQ ID NO: 771 - protein, 28 aa, Homo sapiens
CADISTALPLGSSRPAPAPRHREHEHGH

SEQ ID NO: 772 - protein, 25 aa, Homo sapiens
WTQLTPMGGRPGGRHSPPTLHTGPR

SEQ ID NO: 773 - protein, 20 aa, Homo sapiens
HQPPGTESTSMGTKPGLPGC

SEQ ID NO: 774 - protein, 64 aa, Homo sapiens
SRGSLLPPHLPHRVVVRVHRGAKSLKALRQYIGAAHLQLPWDGKDPARPLGITLCLQMEIQVLG

SEQ ID NO: 775 - protein, 150 aa, Homo sapiens [sequence omitted]

SEQ ID NO: 776 - protein, 25 aa, Homo sapiens
HRGAKSLKALRQYIGAAHLQLPWDG

SEQ ID NO: 777 - protein, 21 aa, Homo sapiens
PAPQARRWASNANGWGWDHQR

SEQ ID NO: 778 - protein, 23 aa, Homo sapiens
HPQYLNLHLQTQCYAQGSGWVLP

SEQ ID NO: 779 - protein, 64 aa, Homo sapiens [sequence omitted]

SEQ ID NO: 780 - protein, 123 aa, Homo sapiens
  SITE (45): Xaa equals any of the naturally occurring L-amino acids
  SITE (46): Xaa equals any of the naturally occurring L-amino acids
  SITE (47): Xaa equals any of the naturally occurring L-amino acids
YNFMFNFSKNCQKVFHSGCIIYIPTGNVQGFLFFHILALTNTSFXXXFCFFIIATLVDVKWHLIVLICISLMTNDIILFLCAYGSKVFPWRNVPSSPLPFQNLVICLLLFSFKKFWPGAVAHL

SEQ ID NO: 781 - protein, 91 aa, Homo sapiens
  SITE (34): Xaa equals any of the naturally occurring L-amino acids
  SITE (66): Xaa equals any of the naturally occurring L-amino acids
  SITE (79): Xaa equals any of the naturally occurring L-amino acids
CVTQARVQWRDLGSLQPPPPGFKRFSCLSLLSRXDYMHLPPRPANFCIFSKMGFHHVGQAGLEVLXSSDLPALASQSAXITGEPLRLARIS

SEQ ID NO: 782 - protein, 25 aa, Homo sapiens
LPPRPANFCIFSKMGFHHVGQAGLE

SEQ ID NO: 783 - protein, 24 aa, Homo sapiens
LILFSIMFLRFIQAVACISTSFLF

SEQ ID NO: 784 - protein, 90 aa, Homo sapiens
  SITE (90): Xaa equals any of the naturally occurring L-amino acids
ALVPSPQQILPSCFSLMWQVTTKSALVFFKCIYIPFLSAPSLPRLENCLIFCSLDVQSQLVFLSSPPVAGVLFFFLLSPLGSKSCSTVEX

SEQ ID NO: 785 - protein, 26 aa, Homo sapiens
APSLPRLENCLIFCSLDVQSQLVFLS

SEQ ID NO: 786 - protein, 13 aa, Homo sapiens
SSPSRVRLRHTPG

SEQ ID NO: 787 - protein, 76 aa, Homo sapiens
  SITE (43): Xaa equals any of the naturally occurring L-amino acids
  SITE (60): Xaa equals any of the naturally occurring L-amino acids
SNTNYCFMFFYFPVKVLVPFKNCYILSLLILPCCICGHQFPRXQACTFCLHTLGGFSFSXLFLVLLSFYVQTGFSV

SEQ ID NO: 788 - protein, 119 aa, Homo sapiens
  SITE (41): Xaa equals any of the naturally occurring L-amino acids
  SITE (97): Xaa equals any of the naturally occurring L-amino acids
  SITE (103): Xaa equals any of the naturally occurring L-amino acids
GTSRHGQRPIAPGTPWQREPRVEVMDPAGGPRGVLPRPCRXLVLLNPRGGKGKALQLFRSHVQPLLAEAEISFTLMLTERRNHARELVRSEELGRWXALVVMXGDGLMHEVVNGLHGAA

SEQ ID NO: 789 - protein, 24 aa, Homo sapiens
RPIAPGTPWQREPRVEVMDPAGGP

SEQ ID NO: 790 - protein, 15 aa, Homo sapiens
  SITE (8): Xaa equals any of the naturally occurring L-amino acids
ASGPLMGXAVLKIFE

SEQ ID NO: 791 - protein, 18 aa, Homo sapiens
  SITE (7): Xaa equals any of the naturally occurring L-amino acids
LLRSALXSPHLPTPVPLV

SEQ ID NO: 792 - protein, 69 aa, Homo sapiens
  SITE (2): Xaa equals any of the naturally occurring L-amino acids
  SITE (24): Xaa equals any of the naturally occurring L-amino acids
  SITE (45): Xaa equals any of the naturally occurring L-amino acids
  SITE (46): Xaa equals any of the naturally occurring L-amino acids
QXRNLAQEAFKWIPQDRPTVRSRXRMGLSIRLPILASNCCALPFXXPTSPLQCLWSCHCSFQANTGLAS

SEQ ID NO: 793 - protein, 59 aa, Homo sapiens
  SITE (53): Xaa equals any of the naturally occurring L-amino acids
QMTQEPPTSVRAHGIAAWGNGCRDKNTKRLIQYWPESCSGMTKGTGVGRWGEXRAERSS

SEQ ID NO: 794 - protein, 21 aa, Homo sapiens
HGIAAWGNGCRDKNTKRLIQY

SEQ ID NO: 795 - protein, 13 aa, Homo sapiens
CERSGYTRMAMDT

SEQ ID NO: 796 - protein, 132 aa, Homo sapiens [sequence omitted]

SEQ ID NO: 797 - protein, 29 aa, Homo sapiens
GSYSRGDWHMRVVGLRGLGASTLQGLLIG

SEQ ID NO: 798 - protein, 27 aa, Homo sapiens
STPAALLGCWPPFREGEILGLQRPGQW

SEQ ID NO: 799 - protein, 44 aa, Homo sapiens
TMGTWVDWLTTNTAHTPAIAAAICAEDFPQRHCGSVERSPDQAC

SEQ ID NO: 800 - protein, 23 aa, Homo sapiens
TNTAHTPAIAAAICAEDFPQRHC

SEQ ID NO: 801 - protein, 15 aa, Homo sapiens
MSPETKGKGRSFPLK

SEQ ID NO: 802 - protein, 82 aa, Homo sapiens [sequence omitted]

SEQ ID NO: 803 - protein, 63 aa, Homo sapiens [sequence omitted]

SEQ ID NO: 804 - protein, 25 aa, Homo sapiens
NKQARAMAFIFKGKDLPFPFVSGDI

SEQ ID NO: 805 - protein, 21 aa, Homo sapiens
YLGSWRSHLYCRLLPMDQVSP

SEQ ID NO: 806 - protein, 25 aa, Homo sapiens
GITIPVILSSGPSHLSTLSLAVSPR

SEQ ID NO: 807 - protein, 11 aa, Homo sapiens
LERLGVGRGLE

SEQ ID NO: 808 - protein, 67 aa, Homo sapiens
  SITE (48): Xaa equals any of the naturally occurring L-amino acids
  SITE (55): Xaa equals any of the naturally occurring L-amino acids
DLPPCWTTLKEHQCFMQYQLFTIQCKVVEQTICEDERKMESTCLTLAXPESVRQXCPATLWSSMNIC

SEQ ID NO: 809 - protein, 49 aa, Homo sapiens
  SITE (5): Xaa equals any of the naturally occurring L-amino acids
TNRVXLSWRKEEQRMGRTETGAKDKGRDFLERGSRGWQLYTGAADTEEV

SEQ ID NO: 810 - protein, 207 aa, Homo sapiens
EQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQG

SEQ ID NO: 811 - protein, 110 aa, Homo sapiens
  SITE (72): Xaa equals any of the naturally occurring L-amino acids
ALLKYRFFYQFLLGNERATAKEIRDEYVETLSKIYLSYYRSYLGRLMKVQYEEVAEKDDLMGVEDTAKKGFXSKPSLRSRNTIFTLGTRGSVISPTELEAPILVPHTAQR

SEQ ID NO: 812 - protein, 97 aa, Homo sapiens
  SITE (16): Xaa equals any of the naturally occurring L-amino acids
  SITE (38): Xaa equals any of the naturally occurring L-amino acids
EQRYPFEALFRSQHYXLLDNSCREYLFICEFFVVSGPXAHDLFHAVMGRTLSMTLKHLDSYLADCYDAIAVFLCIHIVLRFRNIAAKRDVPALDRYW

SEQ ID NO: 813 - protein, 26 aa, Homo sapiens
GGLDTRPHYITRRYAEFSSALVSINQ

SEQ ID NO: 814 - protein, 20 aa, Homo sapiens
SRKEQLVFLINNYDMMLGVL

SEQ ID NO: 815 - protein, 411 aa, Homo sapiens
  SITE (72): Xaa equals any of the naturally occurring L-amino acids
  SITE (111): Xaa equals any of the naturally occurring L-amino acids
  SITE (127): Xaa equals any of the naturally occurring L-amino acids
  SITE (149): Xaa equals any of the naturally occurring L-amino acids
ALLKYRFFYQFLLGNERATAKEIRDEYVETLSKIYLSYYRSYLGRLMKVQYEEVAEKDDLMGVEDTAKKGFXSKPSLRSRNTIFTLGTRGSVISPTELEAPILVPHTAQRXEQRYPFEALFRSQHYXLLDNSCREYLFICEFFVVSGPXAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTS

SEQ ID NO: 816 - protein, 82 aa, Homo sapiens
PADLRAVSGTSEVGLMLLELHHKVVNVDELSPGREGSELRLGQHPVEAMIELDQLGQRSLNDTGAISEVGETPHYILTQRFH

SEQ ID NO: 817 - protein, 120 aa, Homo sapiens
  SITE (12): Xaa equals any of the naturally occurring L-amino acids
  SITE (28): Xaa equals any of the naturally occurring L-amino acids
  SITE (50): Xaa equals any of the naturally occurring L-amino acids
GPHPGASHSAAXEQRYPFEALFRSQHYXLLDNSCREYLFICEFFVVSGPXAHDLFHAVMGRTLSMTLKHLDSYLADCYDAIAVFLCIHIVLRFRNIAAKRDVPALDRYWGTGACLAMATV

SEQ ID NO: 818 - protein, 303 aa, Homo sapiens
YEGKEFDYVFSIDVNEGGPSYKLPYNTSDDPWLTAYNFLQKNDLNPMFLDQVAKFIIDNTKGQMLGLGNPSFSDPFTGGGRYVPGSSGSSNTLPTADPFTGAGRYVPGSASMGTTMAGVDPFTGNSAYRSAASKTMNIYFPKKEAVTFDQANPTQILGKLKELNGTAPEEKKLTEDDLILLEKILSLICNSSSEKPTVQQLQILWKAINCPEDIVFPALDILRLSIKHPSVNENFCNEKEGAQFSSHLINLLNPKGKPANQLLALRTFCNCFVGQAGQKLMMSQRESLMSHAIELKSGSNKNI

SEQ ID NO: 819 - protein, 18 aa, Homo sapiens
HIALATLALNYSVCFHKD

SEQ ID NO: 820 - protein, 49 aa, Homo sapiens
HNIEGKAQCLSLISTILEVVQDLEATFRLLVALGTLISDDSNAVQLAKS

SEQ ID NO: 821 - protein, 30 aa, Homo sapiens
LGVDSQIKKYSSVSEPAKVSECCRFILNLL

SEQ ID NO: 822 - protein, 400 aa, Homo sapiens
YEGKEFDYVFSIDVNEGGPSYKLPYNTSDDPWLTAYNFLQKNDLNPMFLDQVAKFIIDNTKGQMLGLGNPSFSDPFTGGGRYVPGSSGSSNTLPTADPFTGAGRYVPGSASMGTTMAGVDPFTGNSAYRSAASKTMNIYFPKKEAVTFDQANPTQILGKLKELNGTAPEEKKLTEDDLILLEKILSLICNSSSEKPTVQQLQILWKAINCPEDIVFPALDILRLSIKHPSVNENFCNEKEGAQFSSHLINLLNPKGKPANQLLALRTFCNCFVGQAGQKLMMSQRESLMSHAIELKSGSNKNIHIALATLALNYSVCFHKDHNIEGKAQCLSLISTILEVVQDLEATFRLLVALGTLISDDSNAVQLAKSLGVDSQIKKYSSVSEPAKVSECCRFILNLL

SEQ ID NO: 823 - protein, 29 aa, Homo sapiens
LNLLLITQKVKCWDLGIPAFQIHLQVVVG

SEQ ID NO: 824 - protein, 29 aa, Homo sapiens
IKHPSVNENFCNEKEGAQFSSHLINLLNP

SEQ ID NO: 825 - protein, 22 aa, Homo sapiens
AIELKSGSNKNIHIALATLALN

SEQ ID NO: 826 - protein, 23 aa, Homo sapiens
VQLAKSLGVDSQIKKYSSVSEPA

SEQ ID NO: 827 - protein, 26 aa, Homo sapiens
YEGKEFDYVFSIDVNEGGPSYKLPYN

SEQ ID NO: 828 - protein, 26 aa, Homo sapiens
AYNFLQKNDLNPMFLDQVAKFIIDNT

SEQ ID NO: 829 - protein, 15 aa, Homo sapiens
SFSDPFTGGGRYVPG

SEQ ID NO: 830 - protein, 11 aa, Homo sapiens
TADPFTGAGRY

SEQ ID NO: 831 - protein, 19 aa, Homo sapiens
TTMAGVDPFTGNSAYRSAA

SEQ ID NO: 832 - protein, 9 aa, Homo sapiens
NIYFPKKEA

SEQ ID NO: 833 - protein, 19 aa, Homo sapiens
TFDQANPTQILGKLKELNG

SEQ ID NO: 834 - protein, 30 aa, Homo sapiens
PEDIVFPALDILRLSIKHPSVNENFCNEKE

SEQ ID NO: 835 - protein, 31 aa, Homo sapiens
QFSSHLINLLNPKGKPANQLLALRTFCNCFV

SEQ ID NO: 836 - protein, 26 aa, Homo sapiens
QAGQKLMMSQRESLMSHAIELKSGSN

SEQ ID NO: 837 - protein, 139 aa, Homo sapiens
YPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVE

SEQ ID NO: 838 - protein, 144 aa, Homo sapiens
YPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTI

SEQ ID NO: 839 - protein, 14 aa, Homo sapiens
YPNQDGDILRDQVL

SEQ ID NO: 840 - protein, 11 aa, Homo sapiens
EAPWPSAQSEI

SEQ ID NO: 841 - protein, 21 aa, Homo sapiens
SGEESYWWMQFTAAVEFIKTI

SEQ ID NO: 842 - protein, 18 aa, Homo sapiens
ADDFVPVLVFVLIKANPP

SEQ ID NO: 843 - protein, 12 aa, Homo sapiens
YKTPRDKVQCIL

SEQ ID NO: 844 - protein, 15 aa, Homo sapiens
GADDFVPVLVFVLIK

SEQ ID NO: 845 - protein, 12 aa, Homo sapiens
PVLVFVLIKANP

SEQ ID NO: 846 - protein, 17 aa, Homo sapiens
SARASTQPPAGQHPGPC

SEQ ID NO: 847 - protein, 33 aa, Homo sapiens
MPGRWRWQRDMHPARKLLSLLFLILMGTELTQD

SEQ ID NO: 848 - protein, 19 aa, Homo sapiens
SAAPDSLLRSSKGSTRGSL

SEQ ID NO: 849 - protein, 20 aa, Homo sapiens
AAIVIWRGKSESRIAKTPGI

SEQ ID NO: 850 - protein, 17 aa, Homo sapiens
PLGITLPLGAPETGGGD

SEQ ID NO: 851 - protein, 20 aa, Homo sapiens
CAAETWKGSQRAGQLCALLA

SEQ ID NO: 852 - protein, 20 aa, Homo sapiens
FRGGGTLVLPPTHTPEWLIL

SEQ ID NO: 853 - protein, 28 aa, Homo sapiens [sequence omitted]

SEQ ID NO: 854 - protein, 80 aa, Homo sapiens
YIVQGTTSPFEMPTIPTPARHRAPHSPPAGHVATAPQALHIKPAMHTAGRHAGCPSRSQRHNPHRLFLEPPRAALCPKGG

SEQ ID NO: 855 - protein, 97 aa, Homo sapiens
ASNAHSWPARWLPFQVSAAQSPPPVSGAPKGSVMPKGRMSHSGVCVGGRTKVPPPLKMPGVLAIRLSLFPLQMTIAAKDPLVLPFELLSRESGAAES

SEQ ID NO: 856 - protein, 27 aa, Homo sapiens
GRMSHSGVCVGGRTKVPPPLKMPGVLA

SEQ ID NO: 857 - protein, 13 aa, Homo sapiens
GHQTAPETPSRSD

SEQ ID NO: 858 - protein, 5 aa, Homo sapiens
SQTDR

SEQ ID NO: 859 - protein, 22 aa, Homo sapiens
NIYFKEKRKRGGAKMAGAIIEN

SEQ ID NO: 860 - protein, 147 aa, Homo sapiens
VYLCAYTSTINVTVTTANAKLINMCCLVDSNTRSCVVIDEGIFRSAEQFLIKFRNKQSTIFPRFTWELHSIGLVFSIVFMGWCIQEHQSKDIQIPHPIDACEKGTVHLDCDAAPFPMAFRYLTNDEEDDSHGSAGQGDKHEELEPKN

SEQ ID NO: 861 - protein, 112 aa, Homo sapiens
KMPCRMSPNSSIQVQSNPMENHSTGILIKVMEIPRAKMTFSRSTGGRDIMVILLQYHTIMMKMLGVRKVFMANHTLVKPPFWWIPTNRISFISPIPTLIFFFSFTGSRMFKR

SEQ ID NO: 862 - protein, 74 aa, Homo sapiens [sequence omitted]

SEQ ID NO: 863 - protein, 31 aa, Homo sapiens
IKFRNKQSTIFPRFTWELHSIGLVFSIVFMG

SEQ ID NO: 864 - protein, 29 aa, Homo sapiens
SSIQVQSNPMENHSTGILIKVMEIPRAKM

SEQ ID NO: 865 - protein, 33 aa, Homo sapiens
LGVRKVFMANHTLVKPPFWWIPTNRISFISPIP

SEQ ID NO: 866 - protein, 9 aa, Homo sapiens
TMASMGLQV

SEQ ID NO: 867 - protein, 167 aa, Homo sapiens
KSWMMLWAVQDTGTITIRPANRNTTPATIMVLALALSSSRQLVHLPPTTDSSTPRAATMMLMMTRARAACRSCGSASSESYTLHCIWPVLCTTQFIHRPSQMVCEVTMLLPMKAVTRHMGSAQHSMTASQPRTASAMPITCSPMEAIVQRPRELRTWKAEGIRLWGP

SEQ ID NO: 868 - protein, 28 aa, Homo sapiens
LQVMGIALAVLGWLAVMLCCALPMWRVT

SEQ ID NO: 869 - protein, 22 aa, Homo sapiens
SNIVTSQTIWEGLWMNCVVQST

SEQ ID NO: 870 - protein, 18 aa, Homo sapiens
QMQCKVYDSLLALPQDLQ

SEQ ID NO: 871 - protein, 18 aa, Homo sapiens
KCTNCLEDESAKAKTMIV

SEQ ID NO: 872 - protein, 32 aa, Homo sapiens
GVVFLLAGLMVIVPVSWTAHNIIQDFYNPLVA

SEQ ID NO: 873 - protein, 12 aa, Homo sapiens
CCNCPPRTDKPY

SEQ ID NO: 874 - protein, 14 aa, Homo sapiens
PFTAIAGSEIFSLE

SEQ ID NO: 875 - protein, 11 aa, Homo sapiens
SKTEALTQAFR

SEQ ID NO: 876 - protein, 24 aa, Homo sapiens
VVHTVSLHEIDVINSRTQGFLALF

SEQ ID NO: 877 - protein, 15 aa, Homo sapiens
PGVLFIDEVHMLDIE

SEQ ID NO: 878 - protein, 280 aa, Homo sapiens
  SITE (197): Xaa equals any of the naturally occurring L-amino acids
AGIRQRFSARLWQLVSIMATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIXSLTKDKVQAGDVITIDKATGKISKLGRSFTRARELRRYGLPDQVRAVPRWGAPETQGGGAHRVPARDRRHQLSHPGLPGALLR

SEQ ID NO: 879 - protein, 179 aa, Homo sapiens
  SITE (178): Xaa equals any of the naturally occurring L-amino acids
SPSTRRRARSPSWAAPSHAPANYDAMGSQTKFVQCPDGELQKRKEVVHTVSLHEIDVINSRTQGFLALFSGDTGEIKSEVREQINAKVAEWREEGKAEIIPGVLFIDEVHMLDIESFSFLNRALESDMAPVQQVYGDAVRALVAGAPDSRDATVGGLVPNSCSPGDPLVLERPPPRWXS

SEQ ID NO: 880 - protein, 89 aa, Homo sapiens
WIPRAAGIRHEATNRGITRIRGTSYQSPHGIPIDLLDRRHVTLQGPVEEGEALDVQHVDLVDEQHSRDDLRLALLAPLSHLGIDLLTDF

SEQ ID NO: 881 - protein, 30 aa, Homo sapiens
YDAMGSQTKFVQCPDGELQKRKEVVHTVSL

SEQ ID NO: 882 - protein, 31 aa, Homo sapiens
KAEIIPGVLFIDEVHMLDIESFSFLNRALES

SEQ ID NO: 883 - protein, 28 aa, Homo sapiens
EATNRGITRIRGTSYQSPHGIPIDLLDR

SEQ ID NO: 884 - protein, 22 aa, Homo sapiens
MRSARPSLGCLPSWAFSQALNI

SEQ ID NO: 885 - protein, 22 aa, Homo sapiens
LLGLKGLAPAEISAVCEKGNFN

SEQ ID NO: 886 - protein, 26 aa, Homo sapiens
VAHGLAWSYYIGYLRLILPELQARIR

SEQ ID NO: 887 - protein, 18 aa, Homo sapiens
TYNQHYNNLLRGAVSQRC

SEQ ID NO: 888 - protein, 43 aa, Homo sapiens
ILLPLDCGVPDNLSMADPNIRFLDKLPQQTGDRAGIKDRVYSN

SEQ ID NO: 889 - protein, 45 aa, Homo sapiens
SIYELLENGQRAGTCVLEYATPLQTLFAMSQYSQAGFSGEDRLEQ

SEQ ID NO: 890 - protein, 92 aa, Homo sapiens
AKLFCRTLEDILADAPESQNNCRLIAYQEPADDSSFSLSQEVLRHLRQEEKEEVTVGSLKTSAVPSTSTMSQEPELLISGMEKPLPLRTDFS

SEQ ID NO: 891 - protein, 43 aa, Homo sapiens
LLGLKGLAPAEISAVCEKGNFNVAHGLAWSYYIGYLRLILPEL

SEQ ID NO: 892 - protein, 76 aa, Homo sapiens
LRLHSEKLPLAARSAGPSLLVIIQSSQCPGGRRYRGSYWRTVRACLGCPLRRGALLLLSIYFYYSLPNAVGPPFTW

SEQ ID NO: 893 - protein, 133 aa, Homo sapiens [sequence omitted]

SEQ ID NO: 894 - protein, 87 aa, Homo sapiens
GVCQVSFMGPSRPTPHPSPLPLPGDAELSQWYQQAPSPSGSWSCSIIGEPQQKNGEEEEAEFGVLNPPAPTLQHQGCYGLSCRATLA

SEQ ID NO: 895 - protein, 22 aa, Homo sapiens
TMKLLKLRRNIVKLSLYRHFTN

SEQ ID NO: 896 - protein, 22 aa, Homo sapiens
TLILAVAASIVFIIWTTMKFRI

SEQ ID NO: 897 - protein, 28 aa, Homo sapiens
VTCQSDWRELWVDDAIWRLLFSMILFVI

SEQ ID NO: 898 - protein, 27 aa, Homo sapiens
MVLWRPSANNQRFAFSPLSEEEEEDEQ

SEQ ID NO: 899 - protein, 27 aa, Homo sapiens
MVLWRPSANNQRFAFSPLSEEEEEDEQ

SEQ ID NO: 900 - protein, 35 aa, Homo sapiens
KEPMLKESFEGMKMRSTKQEPNGNSKVNKAQEDDL

SEQ ID NO: 901 - protein, 37 aa, Homo sapiens
KWVEENVPSSVTDVALPALLDSDEERMITHFERSKME

SEQ ID NO: 902 - protein, 20 aa, Homo sapiens
DPRVRLNSLTCKHIFISLTQ

SEQ ID NO: 903 - protein, 11 aa, Homo sapiens
NAFGRHSTAVK

SEQ ID NO: 904 - protein, 283 aa, Homo sapiens
  SITE (16): Xaa equals any of the naturally occurring L-amino acids
  SITE (27): Xaa equals any of the naturally occurring L-amino acids
  SITE (65): Xaa equals any of the naturally occurring L-amino acids
ESCLLCGISEYPIQRXICPGCFDPCRXAFSSETLTGSNPGHHSQSGIWHRQATPGVTLHKVVVAXALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 905 - protein, 13 aa, Homo sapiens
  SITE (7): Xaa equals any of the naturally occurring L-amino acids
YEPMDFXMALIYD

SEQ ID NO: 906 - protein, 16 aa, Homo sapiens
IRHELTVLRDTRPACA

SEQ ID NO: 907 - protein, 10 aa, Homo sapiens
  SITE (4): Xaa equals any of the naturally occurring L-amino acids
MDFXMALIYD

SEQ ID NO: 908 - protein, 24 aa, Homo sapiens
MQEMMRNQDRALSNLESIPGGYNA

SEQ ID NO: 909 - protein, 25 aa, Homo sapiens
LRRMYTDIQEPMLSAAQEQFGGNPF

SEQ ID NO: 910 - protein, 32 aa, Homo sapiens
ASLVSNTSSGEGSQPSRTENRDPLPNPWAPQT

SEQ ID NO: 911 - protein, 71 aa, Homo sapiens
SQSSSASSGTASTVGGTTGSTASGTSGQSTTAPNLVPGVGASMFNTPGMQSLLQQITENPQLMQNMLSAPY

SEQ ID NO: 912 - protein, 45 aa, Homo sapiens
MRSMMQSLSQNPDLAAQMMLNNPLFAGNPQLQEQMRQQLPTFLQQ

SEQ ID NO: 913 - protein, 73 aa, Homo sapiens
MQNPDTLSAMSNPRAMQALLQIQQGLQTLATEAPGLIPGFTPGLGALGSTGGSSGTNGSNATPSENTSPTAGT

SEQ ID NO: 914 - protein, 72 aa, Homo sapiens
TEPGHQQFIQQMLQALAGVNPQLQNPEVRFQQQLEQLSAMGFLNREANLQALIATGGDINAAIERLLGSQPS

SEQ ID NO: 915 - protein, 45 aa, Homo sapiens
RNPAMMQEMMRNQDRALSNLESIPGGYNALRRMYTDIQEPMLSAA

SEQ ID NO: 916 - protein, 13 aa, Homo sapiens
GNPFASLVSNTSS

SEQ ID NO: 917 - protein, 11 aa, Homo sapiens
ENRDPLPNPWA

SEQ ID NO: 918 - protein, 17 aa, Homo sapiens
GKILKDQDTLSQHGIHD

SEQ ID NO: 919 - protein, 14 aa, Homo sapiens
GLTVHLVIKTQNRP

SEQ ID NO: 920 - protein, 18 aa, Homo sapiens
SELQSQMQRQLLSNPEMM

SEQ ID NO: 921 - protein, 14 aa, Homo sapiens
PEISHMLNNPDIMR

SEQ ID NO: 922 - protein, 18 aa, Homo sapiens
RQLIMANPQMQQLIQRNP

SEQ ID NO: 923 - protein, 27 aa, Homo sapiens
NLCHVDCQDLLNPNLLAGIHCAKRIVS

SEQ ID NO: 924 - protein, 23 aa, Homo sapiens
LDGFEGYSLSDWLCLAFVESKFN

SEQ ID NO: 925 - protein, 22 aa, Homo sapiens
NENADGSFDYGLFQINSHYWCN

SEQ ID NO: 926 - protein, 27 aa, Homo sapiens
NLCHVDCQDLLNPNLLAGIHCAKRIVS

SEQ ID NO: 927 - protein, 13 aa, Homo sapiens
EPSALSCTSSPPR

SEQ ID NO: 928 - protein, 13 aa, Homo sapiens
IREVNEVIQNPAT

SEQ ID NO: 929 - protein, 30 aa, Homo sapiens
ITRILLSHFNWDKEKLMERYFDGNLEKLFA

SEQ ID NO: 930 - protein, 23 aa, Homo sapiens
NTRSSAQDMPCQICYLNYPNSYF

SEQ ID NO: 931 - protein, 60 aa, Homo sapiens
CDILVDDNTVMRLITDSKVKLKYQHLITNSFVECNRLLKWCPAPDCHHVVKVQYPDAKPV

SEQ ID NO: 932 - protein, 52 aa, Homo sapiens
CDILVDDNTVMRLITDSKVKLKYQHLITNSFVECNRLLKWCPAPDCHHVVKV

SEQ ID NO: 933 - protein, 60 aa, Homo sapiens
GCNHMVCRNQNCKAEFCWVCLGPWEPHGSAWYNCNRYNEDDAKAARDAQERSRAALQRYL

SEQ ID NO: 934 - protein, 60 aa, Homo sapiens
FYCNRYMNHMQSLRFEHKLYAQVKQKMEEMQQHNMSWIEVQFLKKAVDVLCQCRATLMYT

SEQ ID NO: 935 - protein, 60 aa, Homo sapiens
YVFAFYLKKNNQSIIFENNQADLENATEVLSGYLERDISQDSLQDIKQKVQDKYRYCESR

SEQ ID NO: 936 - protein, 37 aa, Homo sapiens
TGLECGHKFCMQCWSEYLTTKIMEEGMGQTISCPAHG

SEQ ID NO: 937 - protein, 21 aa, Homo sapiens
MWGYLFVDAAWNFLGCLICGW

SEQ ID NO: 938 - protein, 46 aa, Homo sapiens
  SITE (21): Xaa equals any of the naturally occurring L-amino acids
MHFISSGNVSAIRSSILLLRXSLSYLGNCLRVSAIFVYFLLFLLLS

SEQ ID NO: 939 - protein, 80 aa, Homo sapiens [sequence omitted]

SEQ ID NO: 940 - protein, 131 aa, Homo sapiens
  SITE (124): Xaa equals any of the naturally occurring L-amino acids
MLPALASCCHFSPPEQAARLKKLQEQEKQQKVEFRKRMEKEVSDFIQDSGQIKKKFQPMNKIERSILHDVVEVAGLTSFSFGEDDDCRYVMIFKKEFAPSDEELDSYRRGEEWDPQKAEEKRNXKELAQRQ

SEQ ID NO: 941 - protein, 76 aa, Homo sapiens
  SITE (47): Xaa equals any of the naturally occurring L-amino acids
EEEAAQQGPVVVSPASDYKDKYSHLIGKGAAKDAAHMLQANKTYGCXPVANKRDTRSIEEAMNEIRAKKRLRQSGE

SEQ ID NO: 942 - protein, 40 aa, Homo sapiens
PPRRPAQLPLTPGAGQGAGRDKAAAIRAHPGAPPLNHLLP

SEQ ID NO: 943 - protein, 28 aa, Homo sapiens
AVPQAGGKQVFDLSPLELGYVRGMCVCV

SEQ ID NO: 944 - protein, 207 aa, Homo sapiens
  SITE (124): Xaa equals any of the naturally occurring L-amino acids
  SITE (178): Xaa equals any of the naturally occurring L-amino acids
MLPALASCCHFSPPEQAARLKKLQEQEKQQKVEFRKRMEKEVSDFIQDSGQIKKKFQPMNKIERSILHDVVEVAGLTSFSFGEDDDCRYVMIFKKEFAPSDEELDSYRRGEEWDPQKAEEKRNXKELAQRQEEEAAQQGPVVVSPASDYKDKYSHLIGKGAAKDAAHMLQANKTYGCXPVANKRDTRSIEEAMNEIRAKKRLRQSGE

SEQ ID NO: 945 - protein, 34 aa, Homo sapiens
  SITE (10): Xaa equals any of the naturally occurring L-amino acids
LLCPVLNSGXSWNFPHPSQPEYSFHGFHSTRLWI

SEQ ID NO: 946 - protein, 28 aa, Homo sapiens
PSTPWFLFLLGLTCPFSTSHPRWDSIPP

SEQ ID NO: 947 - protein, 227 aa, Homo sapiens
ELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVND

SEQ ID NO: 948 - protein, 64 aa, Homo sapiens
ELSISISNVALADEGEYTCSIFTMPVRTAKSLVTVLGIPQKPIITGYKSSLREKDTATLNCQSS

SEQ ID NO: 949 - protein, 65 aa, Homo sapiens
CQSSGSKPAARLTWRKGDQELHGEPTRIQEDPNGKTFTVSSSVTFQVTREDDGASIVCSVNHESL

SEQ ID NO: 950 - protein, 58 aa, Homo sapiens
HESLKGADRSTSQRIEVLYTPTAMIRPDPPHPREGQKLLLHCEGRGNPVPQQYLWEKE

SEQ ID NO: 951 - protein, 52 aa, Homo sapiens
WEKEGSVPPLKMTQESALIFPFLNKSDSGTYGCTATSNMGSYKAYYTLNVND

SEQ ID NO: 952 - protein, 36 aa, Homo sapiens
PSPVPSSSSTYHAIIGGIVAFIVFLLLIMLIFLGHY

SEQ ID NO: 953 - protein, 44 aa, Homo sapiens
LIRHKGTYLTHEAKGSDDAPDADTAIINAEGGQSGGDDKKEYFI

SEQ ID NO: 954 - protein, 123 aa, Homo sapiens
VPELPDRVHQLHQAVQGCALGRPGFPGGPTHSGHHKSHPGPAGGDYNRCDRPGQVHLHNPRGTGRRGQLHPTAGPGVHRRACPSQQLPHRLGPGVPCPSPSLTPVLPSWTQSWCGLPGYTSSS

SEQ ID NO: 955 - protein, 22 aa, Homo sapiens
VHQLHQAVQGCALGRPGFPGGP

SEQ ID NO: 956 - protein, 42 aa, Homo sapiens
PTHSGHHKSHPGPAGGDYNRCDRPGQVHLHNPRGTGRRGQLH

SEQ ID NO: 957 - protein, 55 aa, Homo sapiens
LHPTAGPGVHRRACPSQQLPHRLGPGVPCPSPSLTPVLPSWTQSWCGLPGYTSSS

SEQ ID NO: 958 - protein, 276 aa, Homo sapiens
  SITE (10): Xaa equals any of the naturally occurring L-amino acids
SLRRPRSAAXQTLTTFLSSVSSASSSALPGSREPCDPRAPPPPRSGSAASCCSCCCSCPRRRAPLRSPRGSKRRIRQREVVDLYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 959 - protein, 61 aa, Homo sapiens
  SITE (10): Xaa equals any of the naturally occurring L-amino acids
SLRRPRSAAXQTLTTFLSSVSSASSSALPGSREPCDPRAPPPPRSGSAASCCSCCCSCPRR

SEQ ID NO: 960 - protein, 52 aa, Homo sapiens
RAPLRSPRGSKRRIRQREVVDLYNGMCLQGPAGVPGRDGSPGANGIPGTPGI

SEQ ID NO: 961 - protein, 52 aa, Homo sapiens
TPGIPGRDGFKGEKGECLRESFEESWTPNYKQCSWSSLNYGIDLGKIAECTF

SEQ ID NO: 962 - protein, 66 aa, Homo sapiens
FTKMRSNSALRVLFSGSLRLKCRNACCQRWYFTFNGAECSGPLPIEAIIYLDQGSPEMNSTINIHR

SEQ ID NO: 963 - protein, 51 aa, Homo sapiens
RTSSVEGLCEGIGAGLVDVAIWVGTCSDYPKGDASTGWNSVSRIIIEELPK

SEQ ID NO: 964 - protein, 26 aa, Homo sapiens
TKKENCRPASLMNIDTKILNKILMNQ

SEQ ID NO: 965 - protein, 214 aa, Homo sapiens
  SITE (25): Xaa equals any of the naturally occurring L-amino acids
  SITE (26): Xaa equals any of the naturally occurring L-amino acids
  SITE (90): Xaa equals any of the naturally occurring L-amino acids
  SITE (94): Xaa equals any of the naturally occurring L-amino acids
  SITE (105): Xaa equals any of the naturally occurring L-amino acids
  SITE (120): Xaa equals any of the naturally occurring L-amino acids
MCNLPIKVVCRANAEYMSPSGKVPXXHVGNQVVSELGPIVQFVKAKGHSLSDGLEEVQKAEMKAYMELVNNMLLTAELYLQWCDEATVGXITHXRYGSPYPWPLXHILAYQKQWEVKRKXKAIGWGKKTLDQVLEDVDQCCQALSQRLGTQPYFFNKQPTELDALVFGHLYTILTTQLTNDELSEKVKNYSNLLAFCRRIEQHYFEDRGKGRLS

SEQ ID NO: 966 - protein, 44 aa, Homo sapiens
  SITE (25): Xaa equals any of the naturally occurring L-amino acids
  SITE (26): Xaa equals any of the naturally occurring L-amino acids
MCNLPIKVVCRANAEYMSPSGKVPXXHVGNQVVSELGPIVQFVK

SEQ ID NO: 967 - protein, 44 aa, Homo sapiens
FVKAKGHSLSDGLEEVQKAEMKAYMELVNNMLLTAELYLQWCDE

SEQ ID NO: 968 - protein, 51 aa, Homo sapiens
  SITE (11): Xaa equals any of the naturally occurring L-amino acids
  SITE (15): Xaa equals any of the naturally occurring L-amino acids
  SITE (26): Xaa equals any of the naturally occurring L-amino acids
  SITE (41): Xaa equals any of the naturally occurring L-amino acids
LQWCDEATVGXITHXRYGSPYPWPLXHILAYQKQWEVKRKXKAIGWGKKTL

SEQ ID NO: 969 - protein, 43 aa, Homo sapiens
DQVLEDVDQCCQALSQRLGTQPYFFNKQPTELDALVFGHLYTI

SEQ ID NO: 970 - protein, 41 aa, Homo sapiens
LTTQLTNDELSEKVKNYSNLLAFCRRIEQHYFEDRGKGRLS

SEQ ID NO: 971 - protein, 70 aa, Homo sapiens
  SITE (2): Xaa equals any of the naturally occurring L-amino acids
  SITE (3): Xaa equals any of the naturally occurring L-amino acids
  SITE (4): Xaa equals any of the naturally occurring L-amino acids
MXXXNSHITIFTLNVNGLNAPNERHRLANWIQSQDQVCCIQETHLTGRDTHRLKIKGWRKIYQANGKQKK

SEQ ID NO: 972 - protein, 28 aa, Homo sapiens
FTLNVNGLNAPNERHRLANWIQSQDQVC

SEQ ID NO: 973 - protein, 17 aa, Homo sapiens
THLTGRDTHRLKIKGWR

SEQ ID NO: 974 - protein, 14 aa, Homo sapiens
GWRKIYQANGKQKK

SEQ ID NO: 975 - protein, 54 aa, Homo sapiens
  SITE (37): Xaa equals any of the naturally occurring L-amino acids
IYHLHSWIFFHFKRAFCMCFITMKVIHAHCSKLRKCXNAQISVFCTTLTASYPT

SEQ ID NO: 976 - protein, 23 aa, Homo sapiens
IYHLHSWIFFHFKRAFCMCFITM

SEQ ID NO: 977 - protein, 31 aa, Homo sapiens
  SITE (14): Xaa equals any of the naturally occurring L-amino acids
KVIHAHCSKLRKCXNAQISVFCTTLTASYPT

SEQ ID NO: 978 - protein, 58 aa, Homo sapiens
  SITE (29): Xaa equals any of the naturally occurring L-amino acids
WNLLWYFQRLRLPSILPGLVLASCDGPSXSQAPSPWLTPDPASVQVRLLWDVLTPDPN

SEQ ID NO: 979 - protein, 54 aa, Homo sapiens
QRGIYREILFLTMAALGKDHVDIVAFDKKYKSAFNKLASSMGKEELRHRRAQMP

SEQ ID NO: 980 - protein, 23 aa, Homo sapiens
WNLLWYFQRLRLPSILPGLVLAS

SEQ ID NO: 981 - protein, 191 aa, Homo sapiens
EDDGFNRSIHEVILKNITWYSERVLTEISLGSLLILVVIRTIQYNMTRTRDKYLHTNCLAALANMSAQFRSLHQYAAQRIISLFSLLSKKHNKVLEQATQSLRGSLSSNDVPLPDYAQDLNVIEEVIRMMLEIINSCLTNSLHHNPNLVYALLYKRDLFEQFRTHPSFQDIMQNIDLVISFFSSRLLQAGS

SEQ ID NO: 982 - protein, 38 aa, Homo sapiens
EDDGFNRSIHEVILKNITWYSERVLTEISLGSLLILVV

SEQ ID NO: 983 - protein, 53 aa, Homo sapiens
RTIQYNMTRTRDKYLHTNCLAALANMSAQFRSLHQYAAQRIISLFSLLSKKHN

SEQ ID NO: 984 - protein, 56 aa, Homo sapiens
SCLTNSLHHNPNLVYALLYKRDLFEQFRTHPSFQDIMQNIDLVISFFSSRLLQAGS

SEQ ID NO: 985 - protein, 31 aa, Homo sapiens
KKHNKVLEQATQSLRGSLSSNDVPLPDYAQD

SEQ ID NO: 986 - protein, 15 aa, Homo sapiens
TISNSSFISGYNAKY

SEQ ID NO: 987 - protein, 31 aa, Homo sapiens
LKVAASWELSCQWNGSWKSLSKASLRCPKTD

SEQ ID NO: 988 - protein, 125 aa, Homo sapiens [sequence omitted]

SEQ ID NO: 989 - protein, 79 aa, Homo sapiens
MKMQRTIVIRRDYLHYIRKYNRFEKRHKNMSVHLSPCFRDVQIGDIVTVGECRPLSKTVRFNVLKVTKAAGTKKQFQKF

SEQ ID NO: 990 - protein, 30 aa, Homo sapiens
MADIQTERAYQKQPTIFQNKKRVLLGETGK

SEQ ID NO: 991 - protein, 58 aa, Homo sapiens
KLPRVTNKNIGLGFKDTPRRLLRGTYIDKKCPFTGNVSIRGRILSGVVTQDEDAEDHC

SEQ ID NO: 992 - protein, 38 aa, Homo sapiens
HCHPPRLSALHPQVQPLREAPQEHVCTPVPLLQGRPDR

SEQ ID NO: 993 - protein, 36 aa, Homo sapiens
MKMQRTIVIRRDYLHYIRKYNRFEKRHKNMSVHLSP

SEQ ID NO: 994 - protein, 43 aa, Homo sapiens
CFRDVQIGDIVTVGECRPLSKTVRFNVLKVTKAAGTKKQFQKF

SEQ ID NO: 995 - protein, 33 aa, Homo sapiens
PRRLLRGTYIDKKCPFTGNVSIRGRILSGVVTQ

SEQ ID NO: 996 - protein, 29 aa, Homo sapiens
SRGTGVQTCSCGASRSGCTCGCSADSLGG

SEQ ID NO: 997 - protein, 32 aa, Homo sapiens
QWSSASSSWVTTPERIRPRMDTLPVKGHFLSM

SEQ ID NO: 998 - protein, 60 aa, Homo sapiens
IFYDSDWNPTVDQQAMDRAHRLGQTKQVTVYRLICKGTIEERILQRAKEKSEIQRMVISG

SEQ ID NO: 999 - protein, 67 aa, Homo sapiens
  SITE (19): Xaa equals any of the naturally occurring L-amino acids
  SITE (62): Xaa equals any of the naturally occurring L-amino acids
TRMIDLLEEYMVYRKHTYXRLDGSSKISERRDMVADFQNRNDIFVFLLSTRAGGLGINLTAXDTVHF

SEQ ID NO: 1000 - protein, 32 aa, Homo sapiens
IFYDSDWNPTVDQQAMDRAHRLGQTKQVTVYR

SEQ ID NO: 1001 - protein, 31 aa, Homo sapiens
VYRLICKGTIEERILQRAKEKSEIQRMVISG

SEQ ID NO: 1002 - protein, 33 aa, Homo sapiens
  SITE (19): Xaa equals any of the naturally occurring L-amino acids
TRMIDLLEEYMVYRKHTYXRLDGSSKISERRDM

SEQ ID NO: 1003 - protein, 38 aa, Homo sapiens
  SITE (33): Xaa equals any of the naturally occurring L-amino acids
RRDMVADFQNRNDIFVFLLSTRAGGLGINLTAXDTVHF

SEQ ID NO: 1004 - protein, 37 aa, Homo sapiens
IFYDSDWNPTVDQQAMDRAHRLGQTKQVTVYRLICKG

SEQ ID NO: 1005 - protein, 37 aa, Homo sapiens; identical to SEQ ID NO: 1004

SEQ ID NO: 1006 - protein, 29 aa, Homo sapiens
RLICKGTIEERILQRAKEKSEIQRMVISG

SEQ ID NO: 1007 - protein, 69 aa, Homo sapiens
  SITE (20): Xaa equals any of the naturally occurring L-amino acids
  SITE (63): Xaa equals any of the naturally occurring L-amino acids
GTRMIDLLEEYMVYRKHTYXRLDGSSKISERRDMVADFQNRNDIFVFLLSTRAGGLGINLTAXDTVHFL

SEQ ID NO: 1008 - protein, 364 aa, Homo sapiens
  SITE (259): Xaa equals any of the naturally occurring L-amino acids
  SITE (312): Xaa equals any of the naturally occurring L-amino acids
MSLHGKRKEIYKYEAPWTVYAMNWSVRPDKRFRLALGSFVEEYNNKVQLVGLDEESSEFICRNTFDHPYPTTKLMWIPDTKGVYPDLLATSGDYLRVWRVGETETRLECLLNNNKNSDFCAPLTSFDWNEVDPYLLGTSSIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVRVPAHLXPGTTIEHVSMALLGPHIHPATSALQRMTTRLSSGTSSKCPEPLRTLSWPTQLXGEINNVQWASTQPELSPSATTTAWRYSECSVGGAVPTRQGLLYFLPLPHPQS

SEQ ID NO: 1009 - protein, 136 aa, Homo sapiens
MSLHGKRKEIYKYEAPWTVYAMNWSVRPDKRFRLALGSFVEEYNNKVQLVGLDEESSEFICRNTFDHPYPTTKLMWIPDTKGVYPDLLATSGDYLRVWRVGETETRLECLLNNNKNSDFCAPLTSFDWNEVDPYLL

SEQ ID NO: 1010 - protein, 140 aa, Homo sapiens
  SITE (135): Xaa equals any of the naturally occurring L-amino acids
SFDWNEVDPYLLGTSSIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVRVPAHLXPGTTI

SEQ ID NO: 1011 - protein, 170 aa, Homo sapiens
  SITE (65): Xaa equals any of the naturally occurring L-amino acids
  SITE (118): Xaa equals any of the naturally occurring L-amino acids
VGADGSVRMFDLRHLEHSTIIYEDPQHHPLLRLCWNKQDPNYLATMAMDGMEVVILDVRVPAHLXPGTTIEHVSMALLGPHIHPATSALQRMTTRLSSGTSSKCPEPLRTLSWPTQLXGEINNVQWASTQPELSPSATTTAWRYSECSVGGAVPTRQGLLYFLPLPHPQS

SEQ ID NO: 1012 - protein, 286 aa, Homo sapiens
  SITE (15): Xaa equals any of the naturally occurring L-amino acids
  SITE (258): Xaa equals any of the naturally occurring L-amino acids
LYATATVISSPSTEXLSQDQGDRASLDAADSGRGSWTSCSSGSHDNIQTIQHQRSWETLPFGHTHFDYSGDPAGLWASSSHMDQIMFSDHSTKYNRQNQSRESLEQAQSRASWASSTGYWGEDSEGDTGTIKRRGGKDVSIEAESSSLTSVTTEETKPVPMPAHIAVASSTTKGLIARKEGRYREPPPTPPGYIGIPITDFPEGHSHPARKPPDYNVALQRSRMVARSSDTAGPSSVQQPHGHPTSSRPVNKPQWHKXNESDPRLAPYQSQGFSTEEDEDEQVSAV

SEQ ID NO: 1013 - protein, 42 aa, Homo sapiens
HMDQIMFSDHSTKYNRQNQSRESLEQAQSRASWASSTGYWGE

SEQ ID NO: 1014 - protein, 51 aa, Homo sapiens
SVTTEETKPVPMPAHIAVASSTTKGLIARKEGRYREPPPTPPGYIGIPITD

SEQ ID NO: 1015 - protein, 57 aa, Homo sapiens
  SITE (42): Xaa equals any of the naturally occurring L-amino acids
VALQRSRMVARSSDTAGPSSVQQPHGHPTSSRPVNKPQWHKXNESDPRLAPYQSQGF

SEQ ID NO: 1016 - protein, 41 aa, Homo sapiens
CLLFVFVSLGMRCLFWTIVYNVLYLKHKCNTVLLCYHLCSI

SEQ ID NO: 1017 - protein, 67 aa, Homo sapiens
  SITE (34): Xaa equals any of the naturally occurring L-amino acids
  SITE (46): Xaa equals any of the naturally occurring L-amino acids
  SITE (47): Xaa equals any of the naturally occurring L-amino acids
  SITE (65): Xaa equals any of the naturally occurring L-amino acids
ACSKLIPAFEMVMRAKDNVYHLDCFACQLCNQRXCVGDKFFLKNNXXLCQTDYEEGLMKEGYAPXVR

SEQ ID NO: 1018 - protein, 45 aa, Homo sapiens
SALSEPGAPDRRRPCPESVPRRPDDEQWPPPTALCLDVAPLPPSS

SEQ ID NO: 1019 - protein, 43 aa, Homo sapiens
PVGYLDKQVPDTSVQETDRILVEKRCWDIALGPLKQIPMNLFI

SEQ ID NO: 1020 - protein, 214 aa, Homo sapiens
AHASESGERWWACCGVRFGLRSIEAIGRSCCHDGPGGLVANRGRRFKWAIELSGPGGGSRGRSDRGSGQGDSLYPVGYLDKQVPDTSVQETDRILVEKRCWDIALGPLKQIPMNLFIMYMAGNTISIFPTMMVCMMAWRPIQALMAISATFKMLESSSQKFLQGLVYLIGNLMGLALAVYKCQSMGLLPTHASDWLAFIEPPERMEFSGGGLLL

SEQ ID NO: 1021 - protein, 46 aa, Homo sapiens
ATFKMLESSSQKFLQGLVYLIGNLMGLALAVYKCQSMGLLPTHASD

SEQ ID NO: 1022 - protein, 43 aa, Homo sapiens; identical to SEQ ID NO: 1019

SEQ ID NO: 1023 - protein, 48 aa, Homo sapiens
PTTKLDIMEKKKHIQIRFPSFYHKLVDSGRMRSKRETRREDSDTKHNL

SEQ ID NO: 1024 - protein, 16 aa, Homo sapiens
FLWKSLLLRYFKMRQH

SEQ ID NO: 1025 - protein, 36 aa, Homo sapiens [sequence omitted]

SEQ ID NO: 1026 - protein, 167 aa, Homo sapiens
TEHIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIV

SEQ ID NO: 1027 - protein, 276 aa, Homo sapiens
MTHPGTEHIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF

SEQ ID NO: 1028 - protein, 69 aa, Homo sapiens
TEHIIAVMITELRGKDILSYLEKNISVQMTIAVGTRMPPKNFSRGSLVFVSISFIVLMIISSAWLIFYF

SEQ ID NO: 1029 - protein, 58 aa, Homo sapiens
SISFIVLMIISSAWLIFYFIQKIRYTNARDRNQRRLGDAAKKAISKLTTRTVKKGDKE

SEQ ID NO: 1030 - protein, 66 aa, Homo sapiens
VKKGDKETDPDFDHCAVCIESYKQNDVVRILPCKHVFHKSCVDPWLSEHCTCPMCKLNILKALGIV

SEQ ID NO: 1031 - protein, 106 aa, Homo sapiens
MTHPGTEHIIAVMITELRGKDILSYLEKNISVQMTIAVGTRMPPKNFSRGSLVFVSISFIVLMIISSAWLIFYFIQKIRYTNARDRNQRRLGDAAKKAISKLTTRT

SEQ ID NO: 1032 - protein, 84 aa, Homo sapiens
AAKKAISKLTTRTVKKGDKETDPDFDHCAVCIESYKQNDVVRILPCKHVFHKSCVDPWLSEHCTCPMCKLNILKALGIVPNLPC

SEQ ID NO: 1033 - protein, 86 aa, Homo sapiens
TQAVNRRSALGDLAGDNSLGLEPLRTSGISPLPQDGELTPRTGEINIAVTKEWFIIASFGLLSALTLCYMIIRATASLNANEVEWF

SEQ ID NO: 1034 - protein, 341 aa, Homo sapiens
PLHGVADHLGCDPQTRFFVPPNIKQWIALLQRGNCTFKEKISRAAFHNAVAVVIYNNKSKEEPVTMTHPGTEHIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF

SEQ ID NO: 1035 - protein, 60 aa, Homo sapiens
HGVADHLGCDPQTRFFVPPNIKQWIALLQRGNCTFKEKISRAAFHNAVAVVIYNNKSKEE

SEQ ID NO: 1036 - protein, 314 aa, Homo sapiens
  SITE (189): Xaa equals any of the naturally occurring L-amino acids
MSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSWXLARLVFVPLLLLCNIKPRRYLTVVFEHDAWFIFFMAAFAFSNGYLASLCMCFGPKKVKPAEAETAEPSWPSSCVWVWHWGLFSPSCSGQLCDKGWTEGLPASLPVCLLPLPSARGDPEWSGGFFF

SEQ ID NO: 1037 - protein, 106 aa, Homo sapiens
MSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSI

SEQ ID NO: 1038 - protein, 81 aa, Homo sapiens
SGVSVSNSQPTNESHSIKAILKNISVLAFSVCFIFTITIGMFPAVTVEVKSSIAGSSTWERYFIPVSCFLTFNIFDWLGRS

SEQ ID NO: 1039 - protein, 92 aa, Homo sapiens
  SITE (63): Xaa equals any of the naturally occurring L-amino acids
TIGMFPAVTVEVKSSIAGSSTWERYFIPVSCFLTFNIFDWLGRSLTAVFMWPGKDSRWLPSWXLARLVFVPLLLLCNIKPRRYLTVVFEHDA

SEQ ID NO: 1040 - protein, 74 aa, Homo sapiens
FGPKKVKPAEAETAEPSWPSSCVWVWHWGLFSPSCSGQLCDKGWTEGLPASLPVCLLPLPSARGDPEWSGGFFF

SEQ ID NO: 1041 - protein, 135 aa, Homo sapiens
  SITE (96): Xaa equals any of the naturally occurring L-amino acids
  SITE (97): Xaa equals any of the naturally occurring L-amino acids
  SITE (98): Xaa equals any of the naturally occurring L-amino acids
  SITE (99): Xaa equals any of the naturally occurring L-amino acids
  SITE (100): Xaa equals any of the naturally occurring L-amino acids
  SITE (101): Xaa equals any of the naturally occurring L-amino acids
  SITE (102): Xaa equals any of the naturally occurring L-amino acids
  SITE (103): Xaa equals any of the naturally occurring L-amino acids
  SITE (104): Xaa equals any of the naturally occurring L-amino acids
  SITE (105): Xaa equals any of the naturally occurring L-amino acids
  SITE (106): Xaa equals any of the naturally occurring L-amino acids
  SITE (107): Xaa equals any of the naturally occurring L-amino acids
  SITE (108): Xaa equals any of the naturally occurring L-amino acids
  SITE (109): Xaa equals any of the naturally occurring L-amino acids
  SITE (110): Xaa equals any of the naturally occurring L-amino acids
  SITE (111): Xaa equals any of the naturally occurring L-amino acids
  SITE (112): Xaa equals any of the naturally occurring L-amino acids
  SITE (130): Xaa equals any of the naturally occurring L-amino acids
DDDGFEIVPIEDPAKHRILDPEGLALGAVIASSKKAKRDLIDNSFNRYTFNEDEGELPEWFVQEEKQHRIRQLPVGKKEVEHYRKRWREINARPIXXXXXXXXXXXXXXXXXLEQTRKKAEAVVNTVDIXRTRES

SEQ ID NO: 1042 - protein, 50 aa, Homo sapiens
DDDGFEIVPIEDPAKHRILDPEGLALGAVIASSKKAKRDLIDNSFNRYTF

SEQ ID NO: 1043 - protein, 51 aa, Homo sapiens
  SITE (12): Xaa equals any of the naturally occurring L-amino acids
  SITE (13): Xaa equals any of the naturally occurring L-amino acids
  SITE (14): Xaa equals any of the naturally occurring L-amino acids
  SITE (15): Xaa equals any of the naturally occurring L-amino acids
  SITE (16): Xaa equals any of the naturally occurring L-amino acids
  SITE (17): Xaa equals any of the naturally occurring L-amino acids
  SITE (18): Xaa equals any of the naturally occurring L-amino acids
  SITE (19): Xaa equals any of the naturally occurring L-amino acids
  SITE (20): Xaa equals any of the naturally occurring L-amino acids
  SITE (21): Xaa equals any of the naturally occurring L-amino acids
  SITE (22): Xaa equals any of the naturally occurring L-amino acids
  SITE (23): Xaa equals any of the naturally occurring L-amino acids
  SITE (24): Xaa equals any of the naturally occurring L-amino acids
  SITE (25): Xaa equals any of the naturally occurring L-amino acids
  SITE (26): Xaa equals any of the naturally occurring L-amino acids
  SITE (27): Xaa equals any of the naturally occurring L-amino acids
  SITE (28): Xaa equals any of the naturally occurring L-amino acids
  SITE (46): Xaa equals any of the naturally occurring L-amino acids
KRWREINARPIXXXXXXXXXXXXXXXXXLEQTRKKAEAVVNTVDIXRTRES

SEQ ID NO: 1044 - protein, 216 aa, Homo sapiens
MIKDKGRARTALTSSQPAHLCPENPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPMEEDILQVVKYCTDLIEEKDLEKLDLVIKYMKRLMQQSVESVWNMAFDFILDNVQVVLQQTYGSTLKVT

SEQ ID NO: 1045 - protein, 52 aa, Homo sapiens
MIKDKGRARTALTSSQPAHLCPENPLLHLKAAVKEKKRNKKKKTIGSPKRIQ

SEQ ID NO: 1046 - protein, 100 aa, Homo sapiens
KRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPM

SEQ ID NO: 1047 - protein, 74 aa, Homo sapiens
TISDPMEEDILQVVKYCTDLIEEKDLEKLDLVIKYMKRLMQQSVESVWNMAFDFILDNVQVVLQQTYGSTLKVT

SEQ ID NO: 1048 - protein, 156 aa, Homo sapiens
VCCKTTWTLSRIKSNAIFQTDSTDCCISLFMYFITRSSFSKSFSSIRSVQYFTTWRMSSSIGSEIVVIHSLSKVFTSLNSTAPARLGAGGLTQPAGSDCKLERPGTPEVEAESSSRGFSAGGPSCFRNPSINFWGLPQAPGRVFAGLLSSLLFKGL

SEQ ID NO: 1049 - protein, 25 aa, Homo sapiens
WTLSRIKSNAIFQTDSTDCCISLFM

SEQ ID NO: 1050 - protein, 37 aa, Homo sapiens
FTTWRMSSSIGSEIVVIHSLSKVFTSLNSTAPARLGA

SEQ ID NO: 1051 - protein, 28 aa, Homo sapiens
GGPSCFRNPSINFWGLPQAPGRVFAGLL

SEQ ID NO: 1052 - protein, 18 aa, Homo sapiens
FCHDCKFPEASPAMNCEP

SEQ ID NO: 1053 - protein, 18 aa, Homo sapiens
FCHDCKFPEASPAMNCEP

SEQ ID NO: 1054 - protein, 9 aa, Homo sapiens
HEPYAVLVI

SEQ ID NO: 1055 - protein, 27 aa, Homo sapiens
PQPSNFPTTVRNLPYSGAGAQPPPSNC

SEQ ID NO: 1056 - protein, 134 aa, Homo sapiens
  SITE (130): Xaa equals any of the naturally occurring L-amino acids
MASSVPAGGHTRAGGIFLIGKLDLEASLFKSFQWLPFVLRKKCNFFCWDSSAHSLPLHPLSASCSAPACHASDTHLLYPSTRALCPSIFAWLVAPHSVFRTNAPGPTPSSQSSPVFPVFPVSFMALIVCXLVCC

SEQ ID NO: 1057 - protein, 71 aa, Homo sapiens
MASSVPAGGHTRAGGIFLIGKLDLEASLFKSFQWLPFVLRKKCNFFCWDSSAHSLPLHPLSASCSAPACHA

SEQ ID NO: 1058 - protein, 46 aa, Homo sapiens
  SITE (42): Xaa equals any of the naturally occurring L-amino acids
FAWLVAPHSVFRTNAPGPTPSSQSSPVFPVFPVSFMALIVCXLVCC

SEQ ID NO: 1059 - protein, 134 aa, Homo sapiens; identical to SEQ ID NO: 1056
  SITE (130): Xaa equals any of the naturally occurring L-amino acids

SEQ ID NO: 1060 - protein, 118 aa, Homo sapiens
  SITE (112): Xaa equals any of the naturally occurring L-amino acids
LVNWILKLHCLNLFSGFPLYLEKNATSSAGTHPLTAFPSTLSLPHALPLPAMPPILTFCTPAPVPSAPRSLPGWLLLTQCSGQMLLALPHLASLARSSLSSLFHSWLLLFVXLCAVDF

SEQ ID NO: 1061 - protein, 23 aa, Homo sapiens
NLFSGFPLYLEKNATSSAGTHPL

SEQ ID NO: 1062 - protein, 21 aa, Homo sapiens
PHLASLARSSLSSLFHSWLLL

SEQ ID NO: 1063 - protein, 286 aa, Homo sapiens; identical to SEQ ID NO: 404

SEQ ID NO: 1064 - protein, 16 aa, Homo sapiens
AHASAHASGGAEYGAL

SEQ ID NO: 1065 - protein, 116 aa, Homo sapiens
QYSQYVQSAQLGWTDSCHMLFVTASFRFFSLSASMGSAFSPSISHAHTCLFWNCHLWNSDCNSTYGIDRETDFFPERSCIQYIPARRCFRKYAWPSDPGVRGPHFLDSHQTAMETS

SEQ ID NO: 1066 - protein, 34 aa, Homo sapiens
ASMGSAFSPSISHAHTCLFWNCHLWNSDCNSTYG

SEQ ID NO: 1067 - protein, 119 aa, Homo sapiens
FVHVVARVGWHGTSCSLFSASIWMKNGRIWLLRTFPLRSGDYPKNEGPEHQDQKAKRIYENTFWRECTVCRISQGKNQFLCQSHKCCCNHCSKDDNSRINMYGHEKCSERKRSPWKQKD

SEQ ID NO: 1068 - protein, 32 aa, Homo sapiens
ASIWMKNGRIWLLRTFPLRSGDYPKNEGPEHQ

SEQ ID NO: 1069 - protein, 43 aa, Homo sapiens [sequence omitted]

SEQ ID NO: 1070 - protein, 42 aa, Homo sapiens [sequence omitted]

SEQ ID NO: 1071 - protein, 351 aa, Homo sapiens
NGQASTAKMSSCLRSPPTLAPLSLTSGIPVQSWCGASSQLLQQAVDRAQQLLEVALVLTILQLQAGQHLVLSLQAGQCPAELGVLTVAVPAGGQEDAQCLQHLLTGIMLGQRQEVGRDLAPALFPQAWQEVYLAILLQLLWGHLLGQLSLLLGEHLLRDQVVEQCDHAHGEHLRALLLHQGPQDLQPPELQELPLGIGEVAQQGAQCKQDLLLCSERLLRGQDDQQLLQGSPFDGLHLDLGVAGKGSAQHKRSILLHEGLCAVQPIDHHLKTTKGKQVLRIVHLMDIIFKIKERSNLLFQTGAGTIELVDQPYHDLHVSLNDNIQLIKVFLQFLNGAEEPLYLSLPCLVFL

SEQ ID NO: 1072 - protein, 33 aa, Homo sapiens
QHLVLSLQAGQCPAELGVLTVAVPAGGQEDAQC

SEQ ID NO: 1073 - protein, 26 aa, Homo sapiens
QLSLLLGEHLLRDQVVEQCDHAHGEH

SEQ ID NO: 1074 - protein, 32 aa, Homo sapiens
GSPFDGLHLDLGVAGKGSAQHKRSILLHEGLC

SEQ ID NO: 1075 - protein, 30 aa, Homo sapiens
HLMDIIFKIKERSNLLFQTGAGTIELVDQP

SEQ ID NO: 1076 - protein, 126 aa, Homo sapiens
DEPCPPPAASCAPPSWRMELRTGSVGSQAVARRMDGDSRDGGGGKDATGSEDYENLPTSASVSTHMTAGAMAGILEHSVMYPVDSVKTRMQSLSPDPKAQYTSIYGALKKIMRTEASGGPCEASTS

SEQ ID NO: 1077 - protein, 34 aa, Homo sapiens
RMELRTGSVGSQAVARRMDGDSRDGGGGKDATGS

SEQ ID NO: 1078 - protein, 27 aa, Homo sapiens
PVDSVKTRMQSLSPDPKAQYTSIYGAL

SEQ ID NO: 1079 - protein, 424 aa, Homo sapiens
  SITE (152): Xaa equals any of the naturally occurring L-amino acids
  SITE (314): Xaa equals any of the naturally occurring L-amino acids
  SITE (359): Xaa equals any of the naturally occurring L-amino acids
MKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLXQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPXSGRSTPNRQKTPRGKCSLSQPGPSVSSPHSRSTKGGSDSSLSEPXPGRSGRGFLFRVLRAALPLQLLLLLLIGLACLVPMSEEDYSCALSNNFARSFHPMLRYTNGPPPL

SEQ ID NO: 1080 - protein, 110 aa, Homo sapiens
MKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIK

SEQ ID NO: 1081 - protein, 136 aa, Homo sapiens
  SITE (42): Xaa equals any of the naturally occurring L-amino acids
KLKELQKAVDHRKAIILSINLCSPEFTQADSKESRDLQDRLXQMNGRWDRVCSLLEEWRGLLQDALMQCQGFHEMSHGLLLMLENIDRRKNEIVPIDSNLDAEILQDHHKQLMQIKHELLESQLRVASLQDMSCQL

SEQ ID NO: 1082 - protein, 105 aa, Homo sapiens
  SITE (75): Xaa equals any of the naturally occurring L-amino acids
QDMSCQLLVNAEGTDCLEAKEKVHVIGNRLKLLLKEVSRHIKELEKLLDVSSSQQDLSSWSSADELDTSGSVSPXSGRSTPNRQKTPRGKCSLSQPGPSVSSPHS

SEQ ID NO: 1083 - protein, 73 aa, Homo sapiens
  SITE (8): Xaa equals any of the naturally occurring L-amino acids
DSSLSEPXPGRSGRGFLFRVLRAALPLQLLLLLLIGLACLVPMSEEDYSCALSNNFARSFHPMLRYTNGPPPL

SEQ ID NO: 1084 - protein, 60 aa, Homo sapiens
  SITE (10): Xaa equals any of the naturally occurring L-amino acids
QRFLPPGSCXLIRGPQCPRVTDPTTGQSLDDSRFQIQQTENIIRSKTPTGPELDTSYKGY

SEQ ID NO: 1085 - protein, 215 aa, Homo sapiens
  SITE (64): Xaa equals any of the naturally occurring L-amino acids
SISASRLESIGTISFFLLSMFSSIRSKPWLISWKPWHCIRASCSRPRHSSSREHTRSQRPFICXKRSCRSRLSLLSAWVNSGLQRLMERMMALRWSTAFWSSLSFLIWSSMVWMSVLSSRRWSCSNSSSVSPSQAQMLFKSELNCCHFWRFCFILNSLLNAWAWRSSHRSITPAVWVSVLCRLTKPGRLSSSSFSLCSSLFTESILLLHSPSSFM

SEQ ID NO: 1086 - protein, 35 aa, Homo sapiens
TAFWSSLSFLIWSSMVWMSVLSSRRWSCSNSSSVS

SEQ ID NO: 1087 - protein, 26 aa, Homo sapiens
LLNAWAWRSSHRSITPAVWVSVLCRL

SEQ ID NO: 1088 - protein, 171 aa, Homo sapiens
  SITE (94): Xaa equals any of the naturally occurring L-amino acids
LARHVLQRGYSELGFQQLMLYLHKLFVMVLKYLCIKVRINRDNFIFPSVNVLQHKKQTMAHFMETLALHQGILQQAPPLLQQRAHSVPAPIHLXQAILQVPALLAVSLGELRAAEIDGEDDGFAVVHSFLELLELFDLELDGLDVSAEFQTLELFQLLLRVPQPGPDAVQV

SEQ ID NO: 1089 - protein, 28 aa, Homo sapiens
YSELGFQQLMLYLHKLFVMVLKYLCIKV

SEQ ID NO: 1090 - protein, 29 aa, Homo sapiens
VHSFLELLELFDLELDGLDVSAEFQTLEL

SEQ ID NO: 1091 - protein, 15 aa, Homo sapiens
AMVCFLCWRTLTEGK

SEQ ID NO: 1092 - protein, 97 aa, Homo sapiens
  SITE (73): Xaa equals any of the naturally occurring L-amino acids
GAGVGTAMPRVPQSAGGAVTWWGVGLSQPSSVQGGARPGTVPGTPGPLPGLSPAPPPQHPPPLPKLFLLCLSXSLPQDFSLLLCLSLDPCPSSTSDL

SEQ ID NO: 1093 - protein, 30 aa, Homo sapiens
GTVPGTPGPLPGLSPAPPPQHPPPLPKLFL

SEQ ID NO: 1094 - protein, 158 aa, Homo sapiens
  SITE (83): Xaa equals any of the naturally occurring L-amino acids
  SITE (136): Xaa equals any of the naturally occurring L-amino acids
APSRCRRSVVQVPYSAFSSCSWTPTALRRGVLLYAGLSTSSASKAQGWHCLGLEYPSGAIMEVRGRGGDRYAQGPSKCWRGCXLVGSGSVTAILCPGWGKAWDSARHPRTPSRLVSCSTASTPPTPAQAVSPLPLXFPAPGLLSSPLPLLGPLPFLYL

SEQ ID NO: 1095 - protein, 37 aa, Homo sapiens
TALRRGVLLYAGLSTSSASKAQGWHCLGLEYPSGAIM

SEQ ID NO: 1096 - protein, 33 aa, Homo sapiens
AILCPGWGKAWDSARHPRTPSRLVSCSTASTPP

SEQ ID NO: 1097 - protein, 112 aa, Homo sapiens
  SITE (11): Xaa equals any of the naturally occurring L-amino acids
  SITE (28): Xaa equals any of the naturally occurring L-amino acids
  SITE (67): Xaa equals any of the naturally occurring L-amino acids
PPVFMASHRPXGMEPGEWRFVLVHIAFXCAWDLVCEHVSVCSQVRGRGRAGVQGEAEEKREVLGQGXREAEEKQLGQGWGVLRRWSRRQAWKGSWGAWHCPRPCPTLDRGWL

SEQ ID NO: 1098 - protein, 29 aa, Homo sapiens
HVSVCSQVRGRGRAGVQGEAEEKREVLGQ

SEQ ID NO: 1099 - protein, 56 aa, Homo sapiens
MKLLICGNYLAPSHSESSRRCCLLCFYPLCLEINFGMKVFLSMPFLVLFQSLIQED

SEQ ID NO: 1100 - protein, 50 aa, Homo sapiens
FSSPQGLKFRSKSSLANYLHKNGETSLKPEDFDFTVLSKRGIKSRYKDCS

SEQ ID NO: 1101 - protein, 137 aa, Homo sapiens
ELLCYICWKNTGLFSFFLSVFRGMVSSVKSFLVGEQLLSISEPRFKMSVCKCSFLSTTSTFVPISSDSKKVSSYFSLCSESLAEQNLFMMPEVFCSEQKFDPELNDLSFFFTRLFSSLVTLRVSPHAPASEMQTVLS

SEQ ID NO: 1102 - protein, 36 aa, Homo sapiens
TFVPISSDSKKVSSYFSLCSESLAEQNLFMMPEVFC

SEQ ID NO: 1103 - protein, 271 aa, Homo sapiens
  SITE (112): Xaa equals any of the naturally occurring L-amino acids
  SITE (231): Xaa equals any of the naturally occurring L-amino acids
RILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKXRLNWIQWASLLTLFLSIVALTAGTKTLQHNLAGRGFHHDAFFSPSNSCLLFRNECPRKDNCTAKEWTFPEAKWNTTARVFSHIRLGMGHVLIIVQCFISSMANIYNEKILKEGNQLTEXIFIQNSKLYFFGILFNGLTLGLQRSNRDQIKNCGFFYGHS

SEQ ID NO: 1104 - protein, 30 aa, Homo sapiens
TVNVCSELVKLVFCVLVSFCVIKKDHQSRN

SEQ ID NO: 1105 - protein, 31 aa, Homo sapiens
LIVFYVLSYLQPAMAVIFSNFSIITTALLFR

SEQ ID NO: 1106 - protein, 27 aa, Homo sapiens
FFSPSNSCLLFRNECPRKDNCTAKEWT

SEQ ID NO: 1107 - protein, 28 aa, Homo sapiens
YFFGILFNGLTLGLQRSNRDQIKNCGFF

SEQ ID NO: 1108 - protein, 94 aa, Homo sapiens
  SITE (25): Xaa equals any of the naturally occurring L-amino acids
NSVPNLQTLAVLTEAIGPEPAIPRXPREPPVATSTPATPSAGPQPLPTGTVLVPGGPAPPCLGEAWALLLPPCRPSLTSCFWSPRPSPWKETGV

SEQ ID NO: 1109 - protein, 64 aa, Homo sapiens
  SITE (53): Xaa equals any of the naturally occurring L-amino acids
VTAGRVGGGGPMPPQGKVGQDPQGPARSRLGGAGARQRVWQVWTWQQAAPGGXGGWRALGQWPQ

SEQ ID NO: 1110 - protein, 26 aa, Homo sapiens
STPATPSAGPQPLPTGTVLVPGGPAP

SEQ ID NO: 1111 - protein, 19 aa, Homo sapiens
QDPQGPARSRLGGAGARQR

SEQ ID NO: 1112 - protein, 40 aa, Homo sapiens
  SITE (28): Xaa equals any of the naturally occurring L-amino acids
ALQLAFYPDAVEEWLEENVHPSLQRLQXLLQDLSEVSAPP

SEQ ID NO: 1113 - protein, 30 aa, Homo sapiens
CHPPALAGTLLRTPEGRAHARGLLLEAGGA

SEQ ID NO: 1114 - protein, 59 aa, Homo sapiens
GSSSTRSWFSTSSPQRSASWHSGAPSCRSWRLPCSWLSTRMPWRSGWRKTCTPACSGCK

SEQ ID NO: 1115 - protein, 83 aa, Homo sapiens
  SITE (16): Xaa equals any of the naturally occurring L-amino acids
  SITE (24): Xaa equals any of the naturally occurring L-amino acids
ASTLQPSLSPSSPPLXPPVETAVXSRALRREGAGSFPGSNILALVTQVSLHLRSSVDALLEGNRYVTGWFSPYHRQRKLIHPV

SEQ ID NO: 1116 - protein, 292 aa, Homo sapiens
  SITE (11): Xaa equals any of the naturally occurring L-amino acids
  SITE (15): Xaa equals any of the naturally occurring L-amino acids
  SITE (35): Xaa equals any of the naturally occurring L-amino acids
  SITE (36): Xaa equals any of the naturally occurring L-amino acids
  SITE (39): Xaa equals any of the naturally occurring L-amino acids
  SITE (40): Xaa equals any of the naturally occurring L-amino acids
  SITE (45): Xaa equals any of the naturally occurring L-amino acids
  SITE (91): Xaa equals any of the naturally occurring L-amino acids
  SITE (255): Xaa equals any of the naturally occurring L-amino acids
  SITE (256): Xaa equals any of the naturally occurring L-amino acids
  SITE (257): Xaa equals any of the naturally occurring L-amino acids
  SITE (258): Xaa equals any of the naturally occurring L-amino acids
PLGPEKAGLAXPLVXHAARPCPSTSLQSQCSPSLXXEPXXPPRSXVISGGFDEDVKAKVENLLGISSLEKTDPVRQAPCSPPCPLLPLPFXRPWRQLFSAGLSAGRGPAPSLAATSLPLSHKSASICAALWMRCWRATGMSLAGSAPTTASGSSSTRSWFSTSSPQRSASWHSGAPSCRSWRLPCSWLSTRMPWRSGWRKTCTPACSGCKLCCRTSARCLPPRCHPPALAGTLLRTPEGRAHARGLLLEAGGALXXXXAWAIRPTWASCPLAQQCLAHTQFLRALGSPWGRD

SEQ ID NO: 1117 - protein, 235 aa, Homo sapiens
  SITE (52): Xaa equals any of the naturally occurring L-amino acids
  SITE (164): Xaa equals any of the naturally occurring L-amino acids
  SITE (209): Xaa equals any of the naturally occurring L-amino acids
  SITE (210): Xaa equals any of the naturally occurring L-amino acids
  SITE (211): Xaa equals any of the naturally occurring L-amino acids
FQEDLMKMLKRKWRTFSGFPAWKKRTLLGKHPAALPVPFFPSPSPARGDSCXQQGSPQGGGRLLPWQQHPCPCHTSQPPSAQLCGCAAGGQQVCHWLVQPLPPPAEAHPPGHGSAHPARSAQPPGTVEHPRAGAGGCPAAGFLPGCRGGVAGGKRAPQPAAAAXSAAGPQRGVCPPAATHQPWQGRCSGPLRGELMPGGSCWRLGGLCXXXWPGQYGPRGRRALWPSSVLPTLSS

SEQ ID NO: 1118 - protein, 241 aa, Homo sapiens
  SITE (151): Xaa equals any of the naturally occurring L-amino acids
  SITE (197): Xaa equals any of the naturally occurring L-amino acids
  SITE (198): Xaa equals any of the naturally occurring L-amino acids
  SITE (202): Xaa equals any of the naturally occurring L-amino acids
  SITE (203): Xaa equals any of the naturally occurring L-amino acids
  SITE (206): Xaa equals any of the naturally occurring L-amino acids
  SITE (207): Xaa equals any of the naturally occurring L-amino acids
  SITE (227): Xaa equals any of the naturally occurring L-amino acids
ALPSGVLSNVPARAGGWQRGGRHLAEVLQQSLQPLQAGVHVFLQPLLHGIRVESQLQGSLQLLHEGAPLCQEAERCGLDVLNHDRVDELPLAVVGAEPASDIPVALQQRIHRAAQMEADLCDKGKDVAAREGAGPLPAESPAENSCLHGRXKGRGRRGQGGLQGACLTGSVFSRLEIPRRFSTFALTSSSNPPEITXXRGGXXGSXXREGLHWDCRLVLGHGRAAWXTNGQANPAFSGPKG

SEQ ID NO: 1119 - protein, 29 aa, Homo sapiens
RQLFSAGLSAGRGPAPSLAATSLPLSHKS

SEQ ID NO: 1120 - protein, 28 aa, Homo sapiens
ELPLAVVGAEPASDIPVALQQRIHRAAQ

SEQ ID NO: 1121 - protein, 27 aa, Homo sapiens
QPPGTVEHPRAGAGGCPAAGFLPGCRG

SEQ ID NO: 1122 - protein, 17 aa, Homo sapiens
SVFERTNEFRDVLWSSI

SEQ ID NO: 1123 - protein, 97 aa, Homo sapiens
GVVQVTFMSSVSRVTWGCQPSICPGAPPAAALAGGLRLLFERELFGLPVSSPLICSFLEHHPRTSPPPSDCELLEGRSCVLLFIFLSPEPCTDPGMW

SEQ ID NO: 1124 - protein, 101 aa, Homo sapiens
SKQIHSFVHSFIHLFNTHLLSTYHIPGSVQGSGDRKMNRRTQLLPSRSSQSDGGGDVLGWCSKKEQIRGEETGRPNSSLSKRSLRPPARAAAGGAPGQMLG

SEQ ID NO: 1125 - protein, 28 aa, Homo sapiens
VTWGCQPSICPGAPPAAALAGGLRLLFE

SEQ ID NO: 1126 - protein, 23 aa, Homo sapiens
EQIRGEETGRPNSSLSKRSLRPP

SEQ ID NO: 1127 - protein, 130 aa, Homo sapiens
QWEHLLLLPHLLRGAHRDPGDILPLAPRSECRANSIKEYQKSIWKVYVVRLRLLKPQPNIIPTVKKIVLLAGWALFLFLAYKVSKTDREYQEYNPYEVLNLDPGATVAEIKKQYRLLSLKYHPDKGGDEV

SEQ ID NO: 1128 - protein, 65 aa, Homo sapiens
EERGGGGGAMAGQQFQYDDSGNTFFYFLTSFVGLIVIPATYYLWPRDQNAEQIRLKNIRKVYGRC

SEQ ID NO: 1129 - protein, 220 aa, Homo sapiens
RLYTGCVIFDLVSNRALSFRCMLCCNSCHSASSSLFCFSSCSLSESLSLPSSFSLWESLLVSSSSESLPLSETSSSSSFTAASFPTTPFACFCFCCFDCGNSTGVGFFFKGFFFFDLAVFLGPLLFCCHPPFVLFLLVSPCPSSAGCSSAAQMDCSFSNTSAIVCLVNLTNTVTKDPTVMLLLSSSSNTCDFISMVTYGKLPRTAITSSYFSSSRKCSRV

SEQ ID NO: 1130 - protein, 35 aa, Homo sapiens
YQKSIWKVYVVRLRLLKPQPNIIPTVKKIVLLAGW

SEQ ID NO: 1131 - protein, 35 aa, Homo sapiens
CHPPFVLFLLVSPCPSSAGCSSAAQMDCSFSNTSA

SEQ ID NO: 1132 - protein, 26 aa, Homo sapiens
GTSLDAAATAASLSPRGCRLRTPSSD

SEQ ID NO: 1133 - protein, 99 aa, Homo sapiens
QIQRHTRAPKQLIPLMTPRRSLRDHPQAQTSRQTPRPSSHLVFMRMTPSSMMNTPSGNGGCWSQLCCSSQASSSSPVASAGSCPGYAGIIAGESIRNRS

SEQ ID NO: 1134 - protein, 27 aa, Homo sapiens
PRRSLRDHPQAQTSRQTPRPSSHLVFM

SEQ ID NO: 1135 - protein, 129 aa, Homo sapiens
  SITE (50): Xaa equals any of the naturally occurring L-amino acids
THPPETGAVGRSCAVHHRHHHPHQWQVQAAVPVMPESLQVSPSETGADNXLGTRRPSPLPAHRAQPPASPRRAWPEREDTDDEAGARAAGPSLLPPPTLPAPEGYLAPWGLSLKLSPLLRQKVKHCGLC

SEQ ID NO: 1136 - protein, 36 aa, Homo sapiens
  SITE (16): Xaa equals any of the naturally occurring L-amino acids
PESLQVSPSETGADNXLGTRRPSPLPAHRAQPPASP

SEQ ID NO: 1137 - protein, 79 aa, Homo sapiens
GTAPKAPGSLQGRAGLGEVGDSDRQPWLQLHHLCLPSLARLFEGMQEAGHGELAGGLVFGCPAGCQLLFLMDSPAMIPA

SEQ ID NO: 1138 - protein, 34 aa, Homo sapiens
GEVGDSDRQPWLQLHHLCLPSLARLFEGMQEAGH

SEQ ID NO: 1139 - protein, 86 aa, Homo sapiens
GSGGLSGRLCLGMVSQRASWCHQWDELLWCSCVSLDLSLEAHPFLPVAGSGSGVVVFHQQARLGLERWAGVLCRLHLGLVSGPECP

SEQ ID NO: 1140 - protein, 41 aa, Homo sapiens
QWDELLWCSCVSLDLSLEAHPFLPVAGSGSGVVVFHQQARL

SEQ ID NO: 1141 - protein, 247 aa, Homo sapiens
MRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISICAVPSRCTDCDGCWD

SEQ ID NO: 1142 - protein, 180 aa, Homo sapiens
CLEELVFGDVENDEDALLRRLRGPRVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISICAVPSRCTDCDGC

SEQ ID NO: 1143 - protein, 218 aa, Homo sapiens
LKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKGKALMYRLHHYSDF

SEQ ID NO: 1144 - protein, 167 aa, Homo sapiens
KINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKGKAL

SEQ ID NO: 1145 - protein, 58 aa, Homo sapiens
WLLGLDNAVSLFQVDGKTNPKIQSIYLERFPIFKACFSANGEEVLATSTHSKVLYVYD

SEQ ID NO: 1146 - protein, 23 aa, Homo sapiens
LVFGDVENDEDALLRRLRGPRVQ

SEQ ID NO: 1147 - protein, 29 aa, Homo sapiens
KNASESKLSKDNLKKRLKEEFQHAMGGVP

SEQ ID NO: 1148 - protein, 23 aa, Homo sapiens
SLPRGILKMKNCQHANAERPTVA

SEQ ID NO: 1149 - protein, 246 aa, Homo sapiens
MRILQLILLALATGLVGGETRIIKGFECKLHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCSFPAGAARPDPSYACLTPCDAPTSPSLSTRSVRTPTPATSQTPWCVPACRKGARTPARVTPGALWSVTSLFKALSPGARIRVRSPESLVSTRKSANMWTGSRRR

SEQ ID NO: 1150 - protein, 228 aa, Homo sapiens
ETRIIKGFECKLHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCSFPAGAARPDPSYACLTPCDAPTSPSLSTRSVRTPTPATSQTPWCVPACRKGARTPARVTPGALWSVTSLFKALSPGARIRVRSPESLVSTRKSANMWTGSRRR

SEQ ID NO: 1151 - protein, 74 aa, Homo sapiens
CKLHSQPWQAALFEKTRLLCGATLIAPRWLLTAAHCLKPRYIVHLGQHNLQKEEGCEQTRTATESFPHPGFNNS

SEQ ID NO: 1152 - protein, 81 aa, Homo sapiens
  SITE (21): Xaa equals any of the naturally occurring L-amino acids
  SITE (22): Xaa equals any of the naturally occurring L-amino acids
VLQGRYFSPILEMRRLRPEGXXNLPGGSRAQKEPRQDLTLVLWPHCPHFAMTRSYVPTKQCMVQGSFYCIFIFKGPVQNWC

SEQ ID NO: 1153 - protein, 24 aa, Homo sapiens
CPRRRTCVRVEKSRPFQCQLHSIS

SEQ ID NO: 1154 - protein, 8 aa, Homo sapiens
PKEPGVPE

SEQ ID NO: 1155 - protein, 104 aa, Homo sapiens
LQLKPRDPFSTLGPNAVLSPQRLVLETLSKLSIQDNNVDLILATPPFSRLEKLYSTMVRFLSDRKNPVCRRWLWYCWPTWLRGTAWQLVPLQCRRAVSATSWAS

SEQ ID NO: 1156 - protein, 27 aa, Homo sapiens
RDPFSTLGPNAVLSPQRLVLETLSKLS

SEQ ID NO: 1157 - protein, 105 aa, Homo sapiens
EVISGLFIQSRRRERGQGVVGSHMILWGKSLFFFSPQRLTKNIFKNYSLLLTQRFLFPCETLLLQYVYSIRCTVQYMKGSTLYCTGLSSEQGLFTTANFLAPARL

SEQ ID NO: 1158 - protein, 23 aa, Homo sapiens
IRCTVQYMKGSTLYCTGLSSEQG

SEQ ID NO: 1159 - protein, 211 aa, Homo sapiens
  SITE (103): Xaa equals any of the naturally occurring L-amino acids
  SITE (153): Xaa equals any of the naturally occurring L-amino acids
MPIIDQVNPELHDFMQSAEVGTIFALSWLITWFGHVLSDFRHVVRLYDFFLACHPLMPIYFAAVIVLYREQEVLDCDCDMASVHHLLSQIPQDLPYETLISRXETFLFSFPHPNLLGRPLPNSKLRGRQPLLSKTLSWHQPSRGLIWCCGSGXRGLLRPEDRTKDVLTKPRTNRFVKLAVMGLTVALGAAALAVVKSALEWAPKFQLQLFP

SEQ ID NO: 1160 - protein, 70 aa, Homo sapiens
CPEFFIPATLPCPFVFAFTSEASSRAYLTQRGPGGLAQNLMPLPVGFWMGSLPPPWCWRKWVSEACSCFC

SEQ ID NO: 1161 - protein, 85 aa, Homo sapiens
  SITE (22): Xaa equals any of the naturally occurring L-amino acids
CRQAGAVRGHPMFQFTFYGVTXRFPVTRAAQAQQVAKAAASFRNPLPPTPGRWQRAHPKAHWERHKILCQAPRSPLCQVGSATGL

SEQ ID NO: 1162 - protein, 217 aa, Homo sapiens
  SITE (109): Xaa equals any of the naturally occurring L-amino acids
  SITE (159): Xaa equals any of the naturally occurring L-amino acids
HILNYLMPIIDQVNPELHDFMQSAEVGTIFALSWLITWFGHVLSDFRHVVRLYDFFLACHPLMPIYFAAVIVLYREQEVLDCDCDMASVHHLLSQIPQDLPYETLISRXETFLFSFPHPNLLGRPLPNSKLRGRQPLLSKTLSWHQPSRGLIWCCGSGXRGLLRPEDRTKDVLTKPRTNRFVKLAVMGLTVALGAAALAVVKSALEWAPKFQLQLFP

SEQ ID NO: 1163 - protein, 31 aa, Homo sapiens
AEVGTIFALSWLITWFGHVLSDFRHVVRLYD

SEQ ID NO: 1164 - protein, 33 aa, Homo sapiens
VLTKPRTNRFVKLAVMGLTVALGAAALAVVKSA

SEQ ID NO: 1165 - protein, 20 aa, Homo sapiens
GFGSVSAAGRRSGGTWQPVQ

SEQ ID NO: 1166 - protein, 16 aa, Homo sapiens
PGGLAVGSRWWSRSLT

SEQ ID NO: 1167 - protein, 30 aa, Homo sapiens
LEPSRQRRPRRRGGTSRPETDQRAKCWRQL

SEQ ID NO: 1168 - protein, 11 aa, Homo sapiens
VCLRCQNRMEN

SEQ ID NO: 1169 - protein, 367 aa, Homo sapiens
  SITE (22): Xaa equals any of the naturally occurring L-amino acids
  SITE (34): Xaa equals any of the naturally occurring L-amino acids
  SITE (102): Xaa equals any of the naturally occurring L-amino acids
MAACTARRPGRGQPLVVPVADXGPVAKAALCAAXAGAFSPASTTTTRRHLSSRNRPEGKVLETVGVFEVPKQNGKYETGQLFLHSIFGYRGVVLFPWQARLXDRDVASAAPEKAENPAGHGSKEVKGKTHTYYQVLIDARDCPHISQRSQTEAVTFLANHDDSRALYAIPGLDYVSHEDILPYTSTDQVPIQHELFERFLLYDQTKAPPFVARETLRAWQEKNHPWLELSDVHRETTENIRVTVIPFYMGMREAQNSHVYWWRYCIRLENLDSDVVQLRERHWRIFSLSGTLETVRGRGVVGREPVLSKEQPAFQYSSHVSLQASSGHMWGTFRFERPDGSHFDVRIPPFSLESNKDEKTPPSGLHW

SEQ ID NO: 1170 - protein, 33 aa, Homo sapiens
  SITE (22): Xaa equals any of the naturally occurring L-amino acids
MAACTARRPGRGQPLVVPVADXGPVAKAALCAA

SEQ ID NO: 1171 - protein, 33 aa, Homo sapiens; identical to SEQ ID NO: 1170
  SITE (22): Xaa equals any of the naturally occurring L-amino acids

SEQ ID NO: 1172 - protein, 33 aa, Homo sapiens; identical to SEQ ID NO: 1170
  SITE (22): Xaa equals any of the naturally occurring L-amino acids

SEQ ID NO: 1173 - protein, 33 aa, Homo sapiens; identical to SEQ ID NO: 1170
  SITE (22): Xaa equals any of the naturally occurring L-amino acids

SEQ ID NO: 1174 - protein, 33 aa, Homo sapiens; identical to SEQ ID NO: 1170
  SITE (22): Xaa equals any of the naturally occurring L-amino acids

SEQ ID NO: 1175 - protein, 35 aa, Homo sapiens
VLETVGVFEVPKQNGKYETGQLFLHSIFGYRGVVL

SEQ ID NO: 1176 - protein, 16 aa, Homo sapiens
GLDYVSHEDILPYTST

SEQ ID NO: 1177 - protein, 19 aa, Homo sapiens
DVHRETTENIRVTVIPFYM

SEQ ID NO: 1178 - protein, 21 aa, Homo sapiens
WWRYCIRLENLDSDVVQLRER

SEQ ID NO: 1179 - protein, 26 aa, Homo sapiens
PAFQYSSHVSLQASSGHMWGTFRFER

SEQ ID NO: 1180 - protein, 230 aa, Homo sapiens
  SITE (114): Xaa equals any of the naturally occurring L-amino acids
  SITE (182): Xaa equals any of the naturally occurring L-amino acids
  SITE (194): Xaa equals any of the naturally occurring L-amino acids
RLPSHKRRCFCLVIQKKSFKEFMLDGNLISGGVGEDVFMADIVQAWDGIEGPTVIMVSQEGHSFCLRSLRYMWAVTSINQHLIVSVSFAFHLLGAMASRVLCFFWSCRSHIPVXQSGLPGKQDDTSVAKNAMKEKLPGLIFSILFWHLKHTNCLQHFALWSVSGREVPPRRRGRRWREGSSXGRAQSGLGHRAXVSDRDHQRLPTARPPGCTGCHVPPERRPAADTEPNP

SEQ ID NO: 1181 - protein, 31 aa, Homo sapiens
KEFMLDGNLISGGVGEDVFMADIVQAWDGIE

SEQ ID NO: 1182 - protein, 29 aa, Homo sapiens
AVTSINQHLIVSVSFAFHLLGAMASRVLC

SEQ ID NO: 1183 - protein, 20 aa, Homo sapiens
TARPPGCTGCHVPPERRPAA

SEQ ID NO: 1184 - protein, 11 aa, Homo sapiens
SLCCPEGAEGC

SEQ ID NO: 1185 - protein, 12 aa, Homo sapiens
QLKKTHYDRPCP

SEQ ID NO: 1186 - protein, 12 aa, Homo sapiens
QLKKTHYDRPCP

SEQ ID NO: 1187 - protein, 29 aa, Homo sapiens
MNRPCPFCLWKVFPLLLLLHEELFPLPVP

SEQ ID NO: 1188 - protein, 33 aa, Homo sapiens
KEKTFTPRNSLCCPEGAEGCIAGGDLQLKKTHY

SEQ ID NO: 1189 - protein, 170 aa, Homo sapiens
AQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNMAARWRFWCVSVT

SEQ ID NO: 1190 - protein, 15 aa, Homo sapiens
MVVALLIVCDVPSAS

SEQ ID NO: 1191 - protein, 16 aa, Homo sapiens
AQRKKEMVLSEKVSQL

SEQ ID NO: 1192 - protein, 17 aa, Homo sapiens
MEWTNKRPVIRMNGDKF

SEQ ID NO: 1193 - protein, 56 aa, Homo sapiens
RRLVKAPPRNYSVIVMFTALQLHRQCVVCKQADEEFQILANSWRYSSAFTNRIFFA

SEQ ID NO: 1194 - protein, 31 aa, Homo sapiens
MVDFDEGSDVFQMLNMNSAPTFINFPAKGKP

SEQ ID NO: 1195 - protein, 37 aa, Homo sapiens
KRGDTYELQVRGFSAEQIARWIADRTDVNIRVIRPPN

SEQ ID NO: 1196 - protein, 44 aa, Homo sapiens
YAGPLMLGLLLAVIGGLVYLRRVIWNFSLIKLDGLLQLCVLCLL

SEQ ID NO: 1197 - protein, 17 aa, Homo sapiens
DAVFKGFSDCLLKLGDS

SEQ ID NO: 1198 - protein, 20 aa, Homo sapiens
CQEGAKDMWDKLRKESKNLN

SEQ ID NO: 1199 - protein, 16 aa, Homo sapiens
VLLVSLSAALATWLSF

SEQ ID NO: 1200 - protein, 48 aa, Homo sapiens
MGLKLNGRYISLILAVQIAYLVQAVRAAGKCDAVFKGFSDCLLKLGDS

SEQ ID NO: 1201 - protein, 90 aa, Homo sapiens
PAAWDDKTNIKTVCTYWEDFHSCTVTALTDCQEGAKDMWDKLRKESKNLNIQGSLFELCGSGNGAAGSLLPAFPVLLVSLSAALATWLSF

SEQ ID NO: 1202 - protein, 143 aa, Homo sapiens
  SITE (49): Xaa equals any of the naturally occurring L-amino acids
  SITE (50): Xaa equals any of the naturally occurring L-amino acids
  SITE (51): Xaa equals any of the naturally occurring L-amino acids
  SITE (52): Xaa equals any of the naturally occurring L-amino acids
  SITE (53): Xaa equals any of the naturally occurring L-amino acids
MGLKLNGRYISLILAVQIAYLVQAVRAAGKCDAVFKGFSDCLLKLGDSXXXXXPAAWDDKTNIKTVCTYWEDFHSCTVTALTDCQEGAKDMWDKLRKESKNLNIQGSLFELCGSGNGAAGSLLPAFPVLLVSLSAALATWLSF

SEQ ID NO: 1203 - protein, 34 aa, Homo sapiens
MNSAAGFSHLDRRERVLKLGESFEKQPRCASTLC

SEQ ID NO: 1204 - protein, 28 aa, Homo sapiens
TIYPTEEELQAVQKIVSITERALKLVSD

SEQ ID NO: 1205 - protein, 30 aa, Homo sapiens
RALKGVLRVGVLAKGLLLRGDRNVNLVLLC

SEQ ID NO: 1206 - protein, 39 aa, Homo sapiens
ALAALRHAKWFQARANGLQSCVIIIRILRDLCQRVPTWS

SEQ ID NO: 1207 - protein, 17 aa, Homo sapiens
GDALRRVFECISSGIIL

SEQ ID NO: 1208 - protein, 16 aa, Homo sapiens
LAFRQIHKVLGMDPLP

SEQ ID NO: 1209 - protein, 342 aa, Homo sapiens
TIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGDVTSGMVKDPPDVLDRQKCLDALAALRHAKWFQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGVDGFEAEGKKDKKDYDNF

SEQ ID NO: 1210 - protein, 12 aa, Homo sapiens
MERHPKKKMCSD

SEQ ID NO: 1211 - protein, 31 aa, Homo sapiens
GENSSSDFFPLFLFYFLVALASPPIFVSFIN

SEQ ID NO: 1212 - protein, 24 aa, Homo sapiens
MGSQHSAAARPSSCRRKQEDDRDG

SEQ ID NO: 1213 - protein, 30 aa, Homo sapiens
LLAEREQEEAIAQFPYVEFTGRDSITCLTC

SEQ ID NO: 1214 - protein, 34 aa, Homo sapiens
QGTGYIPTEQVNELVALIPHSDQRLRPQRTKQYV

SEQ ID NO: 1215 - protein, 55 aa, Homo sapiens
ARLNVGRESLKREMLKSQGVKVSESPMGARHSSWPEGAAFCKKVQGAQMQFPPRR

SEQ ID NO: 1216 - protein, 15 aa, Homo sapiens
ARLNVGRESLKREML

SEQ ID NO: 1217 - protein, 20 aa, Homo sapiens
LKSQGVKVSESPMGARHSSW

SEQ ID NO: 1218 - protein, 17 aa, Homo sapiens
AFCKKVQGAQMQFPPRR

SEQ ID NO: 1219 - protein, 17 aa, Homo sapiens
AFCKKVQGAQMQFPPRR

SEQ ID NO: 1220 - protein, 26 aa, Homo sapiens
NFFFVCLFKSSLRLVNSSYTPILCVL

SEQ ID NO: 1221 - protein, 37 aa, Homo sapiens
VQVLEQLTNNAVAESRFNDAAYYYWMLSMQCLDIAQD

SEQ ID NO: 1222 - protein, 34 aa, Homo sapiens
PAQKDTMLGKFYHFQRLAELYHGYHAIHRHTEDP

SEQ ID NO: 1223 - protein, 27 aa, Homo sapiens
LAKQSKALGAYRLARHAYDKLRGLYIP

SEQ ID NO: 1224 - protein, 36 aa, Homo sapiens
ARFQKSIELGTLTIRAKPFHDSEELVPLCYRCSTNN

SEQ ID NO: 1225 - protein, 73 aa, Homo sapiens
PLLNNLGNVCINCRQPFIFSASSYDVLHLVEFYLEEGITDEEAISLIDLEVLRPKRDDRQLEICKQQLPDSCG

SEQ ID NO: 1226 - protein, 29 aa, Homo sapiens
MPYAQWLAENDRFEEAQKAFHKAGRQREA

SEQ ID NO: 1227 - protein, 36 aa, Homo sapiens
FSVHRPETLFNISRFLLHSLPKDTPSGISKVKILFT

What is claimed is:

1. An isolated protein comprising amino acid residues 33 to 205 of SEQ ID NO:463.
2. The isolated protein of claim 1 which comprises amino acid residues 2 to 205 of SEQ ID NO:463.
3. The isolated protein of claim 1 which comprises amino acid residues 1 to 205 of SEQ ID NO:463.
4. The protein of claim 1 which comprises a heterologous polypeptide sequence.
5. A composition comprising the protein of claim 1 and a pharmaceutically acceptable carrier.
6. An isolated protein produced by the method comprising:
   (a) expressing the protein of claim 1 by a cell; and
   (b) recovering said protein.
7. An isolated protein comprising a polypeptide sequence which is at least 95% identical to amino acid residues 33 to 205 of SEQ ID NO:463.
8. The isolated protein of claim 7 wherein said polypeptide sequence is at least 95% identical to amino acid residues 1 to 205 of SEQ ID NO:463.
9. The protein of claim 7 which comprises a heterologous polypeptide sequence.
10. A composition comprising the protein of claim 7 and a pharmaceutically acceptable carrier.
11. An isolated protein produced by the method comprising:
   (a) expressing the protein of claim 7 by a cell; and
   (b) recovering said protein.
12. An isolated protein comprising at least 50 contiguous amino acid residues of amino acid residues 33 to 205 of SEQ ID NO:463.
13. The protein of claim 12 which comprises a heterologous polypeptide sequence.
14. A composition comprising the protein of claim 12 and a pharmaceutically acceptable carrier.
15. An isolated protein produced by the method comprising:
   (a) expressing the protein of claim 12 by a cell; and
   (b) recovering said protein.
16. An isolated protein comprising at least 50 contiguous amino acid residues of amino acid residues 1 to 205 of SEQ ID NO:463.
17. The protein of claim 16 which comprises a heterologous polypeptide sequence.
18. A composition comprising the protein of claim 16 and a pharmaceutically acceptable carrier.
19. An isolated protein produced by the method comprising:
   (a) expressing the protein of claim 16 by a cell; and
   (b) recovering said protein.

* * * * *